(12) United States Patent
Whalen et al.

(10) Patent No.: US 11,591,625 B2
(45) Date of Patent: Feb. 28, 2023

(54) ENZYMATIC PROCESS FOR PRODUCTION OF MODIFIED HOP PRODUCTS

(71) Applicant: KALAMAZOO HOLDINGS, INC., Kalamazoo, MI (US)

(72) Inventors: Katie Whalen, Charlottesville, VA (US); Donald Richard Berdahl, Lawton, MI (US); Brian Patrick Buffin, Yakima, WA (US); Matthew Blake Jones, Portage, MI (US); Katrina Williams, Riner, VA (US)

(73) Assignee: KALAMAZOO HOLDINGS, INC., Kalamazoo, MI (US)

( * ) Notice: Subject to any disclaimer, the term of this patent is extended or adjusted under 35 U.S.C. 154(b) by 37 days.

(21) Appl. No.: 17/147,579

(22) Filed: Jan. 13, 2021

(65) Prior Publication Data

US 2021/0164000 A1    Jun. 3, 2021

Related U.S. Application Data

(63) Continuation-in-part of application No. 17/030,636, filed on Sep. 24, 2020, now abandoned, which is a continuation-in-part of application No. 16/583,762, filed on Sep. 26, 2019, now Pat. No. 10,961,550.

(60) Provisional application No. 62/736,555, filed on Sep. 26, 2018.

(51) Int. Cl.
    *C12P 7/38*    (2006.01)
(52) U.S. Cl.
    CPC .................................... *C12P 7/38* (2013.01)
(58) Field of Classification Search
    CPC ................. C12N 1/20; C12P 7/02; C12P 7/26
    See application file for complete search history.

(56) References Cited

U.S. PATENT DOCUMENTS

| | | | |
|---|---|---|---|
| 2,433,411 | A | 12/1947 | Wallerstein |
| 3,044,879 | A | 7/1962 | Koch et al. |
| 5,624,701 | A | 4/1997 | Maye et al. |
| 6,748,849 | B2 | 6/2004 | Wilson et al. |
| 7,087,256 | B2 | 8/2006 | Gimbel et al. |
| 8,426,178 | B2 | 4/2013 | Savile et al. |
| 2004/0115290 | A1 | 6/2004 | Tripp et al. |
| 2013/0177962 | A1 | 7/2013 | Savile et al. |
| 2020/0095619 | A1 | 3/2020 | Whalen et al. |
| 2021/0010038 | A1* | 1/2021 | Whalen .................. C12P 7/26 |

FOREIGN PATENT DOCUMENTS

| | | |
|---|---|---|
| CN | 108410830 | 8/2018 |
| EP | 0924294 | 6/1999 |
| WO | WO 2004/082697 | 9/2004 |
| WO | WO 2009/029554 | 3/2009 |
| WO | WO 2009/077611 | 6/2009 |
| WO | WO 2010/025238 | 3/2010 |
| WO | WO 2011/059486 | 5/2011 |
| WO | WO 2020/069139 | 4/2020 |
| WO | WO 2021/061915 | 4/2021 |

OTHER PUBLICATIONS

De Keukeleire, Denis, "Fundamentals of beer and hop chemistry", Quimica Nova, 23(1), 2000, pp. 108-112.
Dighionno, Lidia, et al., "Brewing with prolyl endopeptidase from Aspergillus niger: the impact of enzymatic treatment on gluten levels, quality attributes and sensory profile", International Journal of Food Science & Technology, 52, Mar. 2017, pp. 1367-1374.
Gros, Jaques, et al., "Enzymatic release of odourant polyfunctional thiols from cysteine conjugates in hop", J. Inst. Brew. 2013, 119 (4), 221-227.
Hult, Karl, et al., "Enzyme promiscuity: mechanism and applications", Trends in Biotechnology, vol. 25, No. 5, pp. 231-238.
International Search Report for PCT/US2019/053117 dated Feb. 4, 2020.
International Search Report for PCT/US2019/053170 dated Mar. 23, 2020.
Nobeli, Irene, et al., "Protein promiscuity and its implications for biotechnology", Nature Biotechnology, vol. 27, No. 2, Feb. 2009, pp. 157-167.
Partial International Search Report for PCT/US2019/053170 dated Jan. 29, 2020.
Pozen, Morris, A., "Enzymes in brewing", Industrial and Engineering Chemistry, vol. 26, No. 11, Nov. 1934, pp. 1127-1133.
Praet, Tatiana, et al., "Biotransformations of hop-derived aroma compounds by *Saccharomyces cerevisiae* upon fermentation", CEREVISIA 36, 2012, pp. 125-132.
Robinson, Peter, K, "Enzymes: principles and biotechnological applications", Essays Biochem., 59, 2015, pp. 1-41.
Safety Data Sheet for Sodium Borohydride, Sigma-Aldrich, Version 6.5, Jan. 2020, pp. 1-10.
International Search Report for PCT/US2020/052396 dated Mar. 25, 2021.
Huvaere, et al., Photochem. Photobiol. Sci., 2004, 3, 854-858.
Redihop® product information, Jun. 8, 2020.
Reduced Isolone® product information (https://www.kalsec.com/hop-acids).
Todd, et al., MBAA Tech. Quart., 1986, 33, 91-95.
Verzele, et al., J. Inst. Brew., 1986, 92, 32-48.

\* cited by examiner

*Primary Examiner* — Tekchand Saidha
(74) *Attorney, Agent, or Firm* — Hueschen and Sage

(57) ABSTRACT

The present invention relates to a process for producing a beer littering agent via enzyme catalyzed bioconversion of hop-derived isoalpha acids to dihydro-(rho)-isoalpha acids.

17 Claims, 6 Drawing Sheets
Specification includes a Sequence Listing.

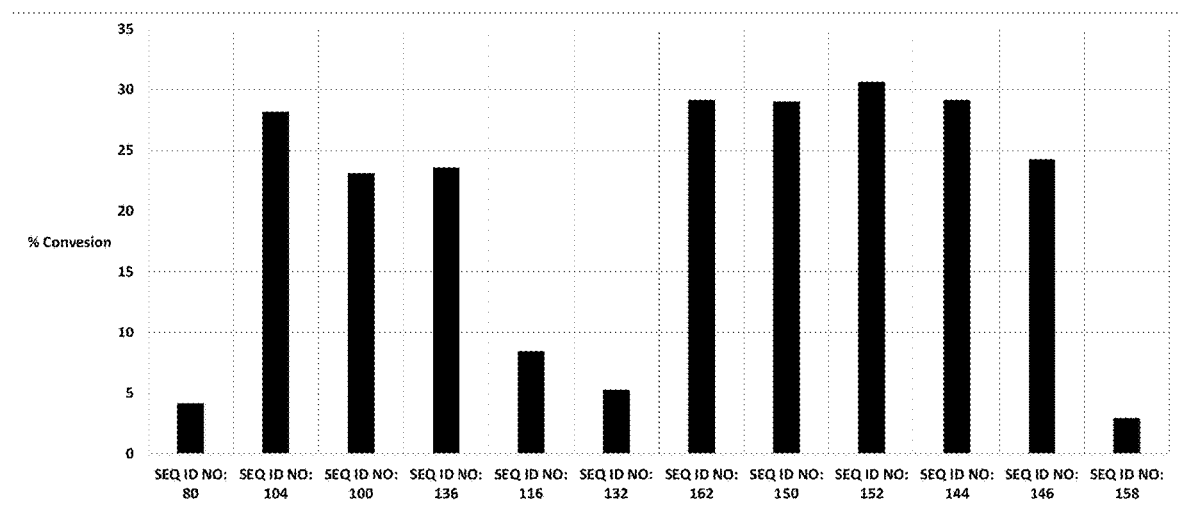
Figure 5 Improved KRED Activity

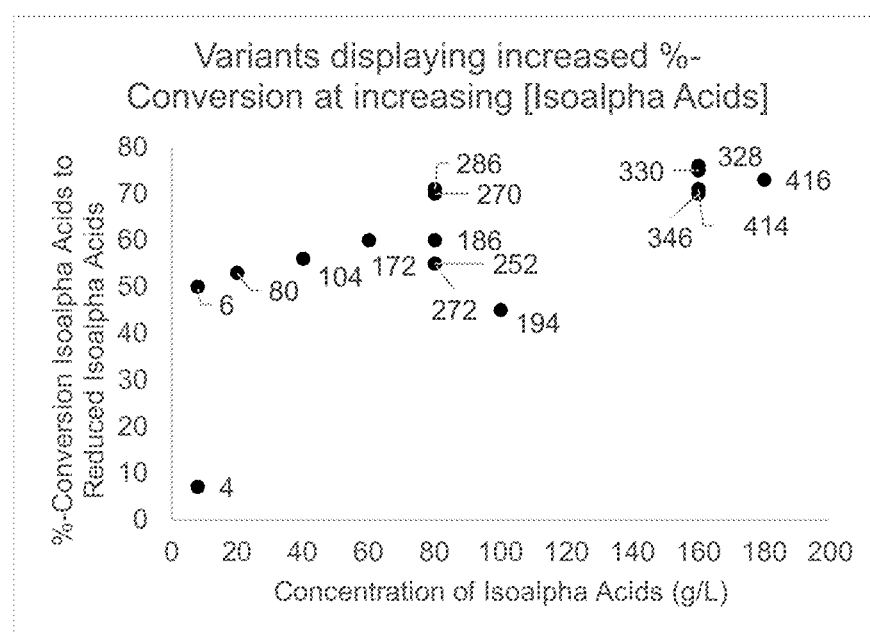
Figure 6 Improved KRED activity compared to SEQ ID NO: 4

ENZYMATIC PROCESS FOR PRODUCTION OF MODIFIED HOP PRODUCTS

REFERENCE TO SEQUENCE LISTING, TABLE OR COMPUTER PROGRAM

The Sequence Listing concurrently submitted herewith under 37 CFR § 1.821 in a computer readable form (CRF) via EFS-Web as file name KALSEC _75_US _CIP_2_ SEQ_LISTING.txt is herein incorporated by reference. The electronic copy of the Sequence Listing was created on 11 Jan. 2021, with a file size of 675 kilobytes.

FIELD OF THE INVENTION

The present invention relates to a process for producing a beer bittering agent via enzyme catalyzed bioconversion of hop-derived isoalpha acids to dihydro-(rho)-isoalpha acids. Dihydro-(rho)-isoalpha acids have superior characteristics which improve utility as a beverage additive. Consumers may prefer dihydro-(rho)-isoalpha acids produced via this process, which does not require the use of harsh chemical reagents and which utilizes enzymes which may be naturally occurring.

BACKGROUND OF THE INVENTION

Traditional methods of bittering beer use whole fresh hops, whole dried hops, or hop pellets added during the kettle boil. Hop extracts made by extracting hops with supercritical carbon dioxide, or isomerized hop pellets, made by heating hops in the presence of a catalyst are more recent bittering innovations that have also been adopted by brewers. Hop pellets can also be added later in the brewing process and in the case of dry hopping, hops are added to the finished beer prior to filtration. These methods suffer from a poor utilization of the bittering compounds present in the hops, which impacts the cost unfavorably. Beer or other malt beverages produced in this manner are unstable to light and must be packaged in dark brown bottles or cans or placed to avoid the light induced formation of 3-methyl-2-butene-1-thiol (3-MBT) which gives a pronounced light-struck or skunky aroma. Placing bottles in cardboard boxes or completely wrapping them in light-proof or light-filtering paper, foil, or plastic coverings is another expensive method of protecting these beverages from light-struck flavor and aroma.

Bitterness in traditionally brewed beer is primarily derived from isoalpha acids. These compounds are formed during the brewing process by the isomerization of the humulones, which are naturally occurring compounds in the lupulin glands of the hop plant. A consequence of this is, given the natural instability of the isoalpha acids towards photochemical reactions in beer, a beverage prone to the formation of light-struck or skunky flavor and aroma.

Fully light stable beers or other malt beverages can be prepared using so-called advanced or modified hop acids. Beers made using these bittering agents can be packaged in non-colored flint glass bottles without fear of forming skunky aromas. Dihydro-(rho)-isoalpha acids are reduction products of isoalpha acids which are light stable. To date, these compounds have not been found in nature. Traditionally, the portion of the isoalpha acids which is responsible for the photochemistry has been altered by reduction of a carbonyl group using sodium borohydride.

Sodium borohydride is an inorganic compound that can be utilized for the reduction of ketones. It is extremely hazardous in case of skin contact, eye contact, inhalation, or ingestion, with an oral LD50 of 160 mg/kg (rat). Sodium borohydride is also flammable, corrosive, and extremely reactive with oxidizing agents, acids, alkalis, and moisture (Sodium Borohydride; MSDS No. S9125; Sigma-Aldrich Co.: Saint Louis, Mo. Nov. 1, 2015.

Consumers are increasingly expressing a preference for natural materials over synthetic or semi-synthetic ones. Thus, a need exists not only to provide compositions employing natural materials as bittering agents for beer and other beverages, but also processes for more natural production of said materials.

Biocatalytic production is an emerging technology which provides highly selective, safe, clean, and scalable production of high value compounds. Biocatalytic production relies on naturally occurring enzymes to replace chemical catalysts.

Enzymes are naturally occurring proteins capable of catalyzing specific chemical reactions. Enzymes exist in nature that are currently capable of replacing chemical catalysts in the production of modified hop bittering compounds (Robinson, P. K., Enzymes: principles and biotechnological applications. Essays Biochem 2015, 59, 1-41.).

Humulone is a natural secondary metabolite that would be exposed to fungi and bacteria cohabitating with the plant, *Humulus lupulus*. It is possible that soil- and plant-dwelling fungi and bacteria possess enzymes capable of modifying humulone for detoxification or scavenging purposes. Additionally, organisms may have evolved enzymes to modify humulone-like molecules, but because of promiscuous activity, these enzymes possess activity against the compounds of interest, isoalpha acids (Hult, K.; Berglund, P., Enzyme promiscuity: mechanism and applications. Trends Biotechnol. 2007, 25 (5), 231-238; Nobeli, I.; Favia, A. D.; Thornton, J. M., Protein promiscuity and its implications for biotechnology. Nat. Biotechnol. 2009, 27 (2), 157-167.).

Enzymes which catalyze oxidation/reduction reactions, that is transfer of hydrogen and oxygen atoms or electrons from one substance to another, are broadly classified as oxidoreductases. More specifically, enzymes that reduce ketone groups to hydroxyl groups are known as ketoreductases or carbonyl reductases and depend on the supplementation of an exogenous source of reducing equivalents (e.g. the cofactors NADH, NADPH). Consistent with the existing naming of the enzymes characterized herein, the enzymes will be referred to as a "ketoreductases".

The cost of expensive cofactors (NADH, NADPH) can be reduced by including additional enzymes and substrates for cofactor recycling, for example glucose dehydrogenase and glucose, or by utilizing a ketoreductase that is also capable of oxidizing a low-cost and natural feedstock, such as ethanol.

Abundant precedence exists for the utility of enzymes in brewing and their favorable influence on the final character of beer (Pozen, M., Enzymes in Brewing. Ind. Eng. Chem, 1934, 26 (11), 1127-1133.). The presence of yeast enzymes in the natural fermentation of beer is known to produce compounds that affect the flavor and aroma of the final beverage (Praet, T.; Opstaele, F.; Jaskula-Goiris, B.; Aerts, G.; De Cooman, L., Biotransformations of hop-derived aroma compounds by *Saccharomyces cerevisiae* upon fermentation. Cerevisia, 2012, 36, 125-132.). Exogenously added enzymes provide a variety of improvements to the brewing process, such as reduced viscosity, increased fermentable sugars, chill-proofing and clarification (Wallerstein, L. (1947) Bentonite and Proteolytic Enzyme Treatment of Beer, U.S. Pat. No. 2,433,411; Ghionno, L.;

Marconi, O.; Sileoni, V.; De Francesco, G.; Perretti, G., Brewing with prolyl endopeptidase from *Aspergillus niger* the impact of enzymatic treatment on gluten levels, quality attributes, and sensory profile. Int. J. Food Sci. Technol, 2017, 52 (6), 1367-1374.). Additionally, hop extracts have been specifically pretreated with enzymes for modifying hop-derived aroma compounds (Gros, J.; Tran, T. T. H.; Collin, S., Enzymatic release of odourant polyfunctional thiols from cysteine conjugates in hop. J. Inst. Brew. 2013, 119 (4), 221-227.).

Prior to the present invention, however, enzymes capable of catalyzing the reduction of isoalpha acids to dihydro-(rho)-isoalpha acids have not been observed in nature, and thus have not been described in the literature. The process disclosed herein represents a novel enzymatic reaction.

OBJECT OF THE INVENTION

It is an object of the present invention to provide a process for enzymatic production of dihydro-(rho)-isoalpha acids, a modified version of natural bittering agents derived from the hop plant. The present process is designed to replace current production processes which utilize the chemical reagent, sodium borohydride.

SUMMARY OF THE INVENTION

The present invention relates to a process that can be scaled up to industrial levels for bioconversion of iso-alpha acids into dihydro-(rho)-isoalpha acids, which can then be used as a naturally derived and light stable bittering agent in beverages.

One aspect of the present invention is a process for the high-yield bioconversion of iso-alpha acids into dihydro-(rho)-isoalpha acids utilizing a ketoreductase enzyme or a microorganism expressing a gene that encodes said ketoreductase.

A further aspect of the invention relates to such a process for production of dihydro-(rho)-isoalpha acids, wherein the process is carried out in an aqueous system with mild temperature and pH conditions, making it an environmentally benign manufacturing process.

In an embodiment of the invention, bioconversion of isoalpha acids to dihydro-(rho)-isoalpha acids comprises the addition of purified ketoreductase enzyme and NADPH or NADP to a mixture of isoalpha acids followed by incubation until the desired yield is obtained.

In another embodiment of the invention, bioconversion of isoalpha acids to dihydro-(rho)-isoalpha acids comprises the addition of purified ketoreductase enzyme and NADPH or NADP to a mixture of isoalpha acids in the presence of isopropanol for cofactor recycling, followed by incubation until the desired yield is obtained.

In a further embodiment of the invention, the concentration of isoalpha acids, i.e. the substrate, is maximized to increase the volumetric productivity of the bioconversion.

In a further embodiment of the invention, the concentration of the cofactor NADPH or NADP in the mixture is minimized to improve the economics of the bioconversion.

In a further embodiment of the invention, the bioconversion is performed in a vessel purged of air with an inert gas such as nitrogen or argon to prevent the formation of degradation products.

In an embodiment of the invention, bioconversion of isoalpha acids to dihydro-(rho)-isoalpha acids comprises the addition of purified ketoreductase enzyme and NADPH or NADP to a mixture of isoalpha acids in the presence of another enzyme (such as glucose dehydrogenase) for cofactor recycling, followed by incubation until the desired yield is obtained.

In another embodiment of the invention, bioconversion of isoalpha acids to dihydro-(rho)-isoalpha acids comprises the addition of a whole cell biocatalyst to a mixture of isoalpha acids followed by incubation until the desired yield is obtained, wherein the whole cell biocatalyst is an immobilized microorganism expressing the gene which encodes a ketoreductase.

In another embodiment of the invention, bioconversion of isoalpha acids to dihydro-(rho)-isoalpha acids comprises the feeding of isoalpha acids to a growing microorganism expressing the gene which encodes a ketoreductase.

In another embodiment of the invention, bioconversion of alpha acids to dihydro-(rho)-isoalpha acids comprises the addition of thermostable ketoreductase enzyme to an extract of alpha acids wherein heat is applied, and the mixture is incubated until the desired yield of dihydro-(rho)-isoalpha acids is achieved.

In another embodiment of the invention, the ketoreductase employed in the process according to the present invention displays a preference for reducing the carbonyl group in the side chain at C(4) of the isoalpha acids, converting the light-sensitive acyloin group to a secondary alcohol, and producing a light-stable isoalpha acid derivative (FIG. 1).

In another embodiment of the invention, the ketoreductase employed in the process according to the present invention advantageously displays minimal or no preference for catalyzing reduction of any one particular member of the six major isoalpha acids: cis-isohumulone, trans-isohumulone, cis-isocohumulone, trans-isocohumulone, cis-isoadhumulone, and trans-isoadhumulone.

In another embodiment of the invention, the ketoreductase employed in the process according to the present invention specifically reduces cis-isohumulone, cis-isocohumulone, and cis-isoadhumulone.

In another embodiment of the invention, the ketoreductase employed in the process according to the present invention specifically reduces trans-isohumulone, trans-isocohumulone, and trans-isoadhumulone.

In another embodiment of the invention, a mixture of 2 or more ketoreductase enzymes displaying the above substrate specificity is employed in the process according to the present invention to reduce a mixture of cis- and trans-isoalpha acids, to their respective dihydroisoalpha acids.

In another embodiment of the invention, a mixture of 2 or more ketoreductase enzymes displaying substrate specificity can be added to a reaction mixture to produce a unique mixture of dihydroisoalpha acids that is distinct from that produced by chemical reducing agents, such as sodium borohydride.

In a further embodiment, the present invention relates to a process as defined above, wherein the commercially available ketoreductase is selected from KRED-P1-B05, KRED-P2-B02, KRED-P2-C02, KRED-P2-C11, KRED-P2-D11, KRED-P2-G03, KRED-P2-G09, KRED-101, KRED-119, KRED-130, KRED-NADH-110, KRED-430, KRED-431, KRED-432, KRED-433, KRED-434, KRED-435, and KRED-436.

A further embodiment of the invention relates to a ketoreductase enzyme which comprises the amino acid sequence of SEQ ID NO: 4, SEQ ID NO: 6, SEQ ID NO: 80, SEQ ID NO: 104, SEQ ID NO: 100, SEQ ID NO: 136, SEQ ID NO:

116, SEQ ID NO: 132, SEQ ID NO: 162, SEQ ID NO: 150, SEQ ID NO: 152, SEQ ID NO: 144, SEQ ID NO: 146 or SEQ ID NO: 158.

A further embodiment of the invention relates to a ketoreductase enzyme which comprises the amino acid sequence of SEQ ID NO: 172, SEQ ID NO: 186, SEQ ID NO: 194, SEQ ID NO: 196, SEQ ID NO: 252, SEQ ID NO: 270, SEQ ID NO: 272, SEQ ID NO: 286, SEQ ID NO: 300, SEQ ID NO: 328, SEQ ID NO: 330, SEQ ID NO: 346, SEQ ID NO: 348, SEQ ID NO: 356, SEQ ID NO: 414, and SEQ ID NO: 416.

In a further embodiment, the present invention relates to a process as defined above, wherein the ketoreductase enzyme comprises the amino acid sequence of SEQ ID NO: 4, SEQ ID NO: 6, SEQ ID NO: 80, SEQ ID NO: 104, SEQ ID NO: 100, SEQ ID NO: 136, SEQ ID NO: 116, SEQ ID NO: 132, SEQ ID NO: 162, SEQ ID NO: 150, SEQ ID NO: 152, SEQ ID NO: 144, SEQ ID NO: 146 or SEQ ID NO: 158.

In a further embodiment, the present invention relates to a process as defined above, wherein the ketoreductase enzyme or microorganism expressing a gene which encodes the ketoreductase enzyme can optionally have one or more differences at amino acid residues as compared to the ketoreductase enzyme which comprises the amino acid sequence of SEQ ID NO: 4, SEQ ID NO: 6, SEQ ID NO: 80, SEQ ID NO: 104, SEQ ID NO: 100, SEQ ID NO: 136, SEQ ID NO: 116, SEQ ID NO: 132, SEQ ID NO: 162, SEQ ID NO: 150, SEQ ID NO: 152, SEQ ID NO: 144, SEQ ID NO: 146 or SEQ ID NO: 158.

In a further embodiment, the present invention relates to a process as defined above, wherein the ketoreductase is 99, 95, 90, 85, 80, 75 or 70 percent homologous to the ketoreductase enzyme which comprises the amino acid sequence of SEQ ID NO: 4, SEQ ID NO: 6, SEQ ID NO: 80, SEQ ID NO: 104, SEQ ID NO: 100, SEQ ID NO: 136, SEQ ID NO: 116, SEQ ID NO: 132, SEQ ID NO: 162, SEQ ID NO: 150, SEQ ID NO: 152, SEQ ID NO: 144, SEQ ID NO: 146 or SEQ ID NO: 158.

In a further embodiment, the present invention relates to a process as defined above, wherein the ketoreductase enzyme comprises the amino acid sequence of SEQ ID NO: 172, SEQ ID NO: 186, SEQ ID NO: 194, SEQ ID NO: 196, SEQ ID NO: 252, SEQ ID NO: 270, SEQ ID NO: 272, SEQ ID NO: 286, SEQ ID NO: 300, SEQ ID NO: 328, SEQ ID NO: 330, SEQ ID NO: 346, SEQ ID NO: 348, SEQ ID NO: 356, SEQ ID NO: 414, or SEQ ID NO: 416.

In a further embodiment, the present invention relates to a process as defined above, wherein the ketoreductase enzyme or microorganism expressing a gene which encodes the ketoreductase enzyme can optionally have one or more differences at amino acid residues as compared to the ketoreductase enzyme which comprises the amino acid sequence of SEQ ID NO: 172, SEQ ID NO: 186, SEQ ID NO: 194, SEQ ID NO: 196, SEQ ID NO: 252, SEQ ID NO: 270, SEQ ID NO: 272, SEQ ID NO: 286, SEQ ID NO: 300, SEQ ID NO: 328, SEQ ID NO: 330, SEQ ID NO: 346, SEQ ID NO: 348, SEQ ID NO: 356, SEQ ID NO: 414, or SEQ ID NO: 416.

In a further embodiment, the present invention relates to a process as defined above, wherein the ketoreductase is 99, 95, 90, 85, 80, 75 or 70 percent homologous to the ketoreductase enzyme which comprises the amino acid sequence of SEQ ID NO: 172, SEQ ID NO: 186, SEQ ID NO: 194, SEQ ID NO: 196, SEQ ID NO: 252, SEQ ID NO: 270, SEQ ID NO: 272, SEQ ID NO: 286, SEQ ID NO: 300, SEQ ID NO: 328, SEQ ID NO: 330, SEQ ID NO: 346, SEQ ID NO: 348, SEQ ID NO: 356, SEQ ID NO: 414, or SEQ ID NO: 416.

BRIEF DESCRIPTION OF THE DRAWINGS

FIG. 5 shows improved KRED Activity of SEQ ID NO: 80, 104, 100, 136, 116, 132, 162, 150, 152, 144, 146 and 158 at High Substrate and low NADP Concentration.

FIG. 6 shows improved KRED activity of SEQ ID NO: 6, SEQ ID NO: 80, SEQ ID NO: 104, SEQ ID NO: 172, SEQ ID NO: 186, SEQ ID NO: 194, SEQ ID NO: 252, SEQ ID NO: 270, SEQ ID NO: 272, SEQ ID NO: 286, SEQ ID NO: 328, SEQ ID NO: 330, SEQ ID NO: 346, SEQ ID NO: 414 and SEQ ID NO: 416 compared to SEQ ID NO: 4 where %-conversion increases at increasing concentrations of isoalpha acids (substrate).

DETAILED DESCRIPTION OF THE INVENTION

Figure 1:
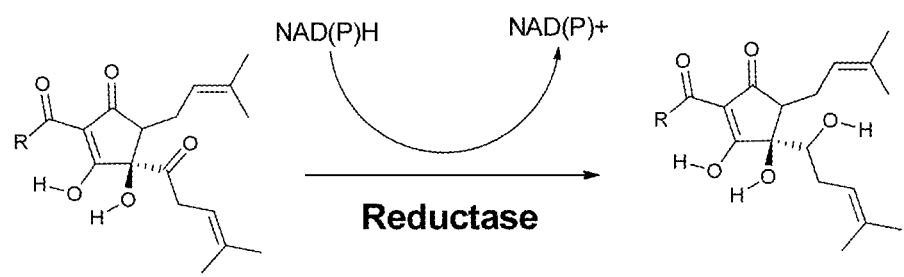
FIG. 1 shows the enzyme catalyzed reduction of a representative epimer of isoalpha acids.

In this invention, a ketoreductase enzyme replaces the function of sodium borohydride and allows a more natural production method for the beverage additive, dihydro-(rho)-isoalpha acids. The enzyme may be any ketoreductase specifically reducing a ketone group to a hydroxy group of any or all isomers of isoalpha acid (co-, n- ad-, and cis/trans-). The enzyme may be derived from, but not limited to, bacteria, fungi, or plants. The enzyme may be cofactor dependent (NADH or NADPH) or independent.

Herein, "isoalpha acids", "hop isoalpha acids", and "hop-derived isoalpha acids" may be used interchangeably.

Isoalpha acid solution is subjected to enzymatic treatment using a purified enzyme or a mixture containing an enzyme and optionally additional enzymes for cofactor recycling. The amount of enzyme depends on the incubation parameters including duration, temperature, amount and concentration of substrate.

Alternatively, an isoalpha acid solution is subjected to enzymatic treatment using a mixture containing a microorganism expressing said enzyme. The invention furthermore provides a process for reducing isoalpha acids according to the invention, which comprises cultivating a ketoreductase-producing microorganism, if appropriate inducing the expression of the ketoreductase, Intact cells can be harvested and added directly to a reaction, in place of isolated enzyme, for the reduction of isoalpha acids as described above. Furthermore, the harvested cells can be immobilized prior to addition to a reduction reaction. The microorganism can be cultivated and fermented by known methods. The microorganism can be bacteria or fungi.

A mixture of cis- and trans-isoalpha acids may be incubated with a single ketoreductase displaying the capacity to reduce both isomers. Alternatively, a mixture of cis- and trans-isoalpha acids may be incubated with 2 or more ketoreductases showing varying specificity where the resulting product is a mixture of cis- and trans-dihydroisoalpha acids.

Alternatively, a solution containing only cis-isoalpha acids may be incubated with a ketoreductase specific for the cis-isomer, and the resulting product is a solution of cis-dihydroisoalpha acids. A solution of only cis-dihydroisoalpha acids may display advantageous bitterness and/or thermal stability properties.

Alternatively, a solution containing only trans-isoalpha acids may be incubated with a ketoreductase specific for the trans-isomer, and the resulting product is a solution of trans-dihydroisoalpha acids. A solution of only trans-dihydroisoalpha acids may display advantageous bitterness properties.

Customized blends of trans- and cis-isoalpha acids may be incubated with 1 or more ketoreductases displaying variable substrate specificity, to produce unique blends of dihydroisoalpha acids otherwise unattainable.

An isoalpha acid mixture may be subjected to an enzymatic reaction using a ketoreductase enzyme in addition to enzymes for catalyzing additional desired modifications, such as but not limited to, dehydrogenases, isomerases, hydratases and lyases. Enzymes of varying activity may be combined in a one pot reaction or added sequentially.

A suitable solvent to use in the enzyme incubation includes water and mixtures of water with another solvent compatible with the enzyme, such as ethanol or isopropanol. Enzymatic activity benefits from buffering of aqueous solutions, Buffering agents include, but are not limited to: tris(hydroxymethyl)aminomethane (aka. Tris), 4-(2-hydroxyethyl)piperazine-1-ethanesulfonic acid (aka. HEPES), sodium phosphate, and potassium phosphate.

The enzyme and isoalpha acids are incubated within a suitable pH range, for example pH 6 to 10, and temperature range, for example 10 to 90° C., and held at this temperature for a sufficient time to convert isoalpha acids to the desired dihydro-(rho)-isoalpha acids yield. Continuous stirring will ensure a constant temperature and exposure of substrate to enzyme. The reaction duration, typically 24 to 48 hours, will depend on the amount and concentration of the enzyme and substrate, solvent present, and temperature chosen.

Enzyme may be free in solution, immobilized onto beads or similar mixable scaffolds, or immobilized onto a film or resin over which a solution of isoalpha acids is passed. The purity level of the enzyme may vary from 30 to 90+% depending on the purification method.

Enzyme may be removed from the final product via physical filtering or centrifugation, Enzyme may also be rendered inactive by extreme temperature or pH and remain in the final product.

As used herein ketoreductase includes commercially available ketoreductases such as KRED-P1-B05, KRED-P2-B02, KRED-P2-C02, KRED-P2-C11, KRED-P2-D11, KRED-P2-G03, KRED-P2-G09, KRED-101, KRED-119, KRED-130, KRED-NADH-110, KRED-430, KRED-431, KRED-432, KRED-433, KRED-434, KRED-435, and KRED-436 (available from Codexis, Inc., Redwood City, Calif.). The invention also contemplates the foregoing ketoreductase which embody one or more differences in amino acid residues, as well as ketoreductase having 99, 95, 90, 85, 80, 75 and/or 70 percent homology with the foregoing ketoreductases.

The invention also includes ketoreductases purposely produced through known mutagenesis methods displaying variable activity on a single or a mixture of isoalpha acids such as SEQ ID NO: 80, SEQ ID NO: 104, SEQ ID NO: 172, SEQ ID NO: 186, SEQ ID NO: 194, SEQ ID NO: 196, SEQ ID NO: 252, SEQ ID NO: 270, SEQ ID NO: 272, SEQ ID NO: 286, SEQ ID NO: 300, SEQ ID NO: 328, SEQ ID NO: 330, SEQ ID NO: 346, SEQ ID NO: 348 SEQ ID NO: 356, SEQ ID NO: 414, and SEQ ID NO: 416. Some variants are significantly improved in substrate tolerance, temperature tolerance, solvent tolerance, substrate specificity (or lack thereof) and/or turnover compared to commercially available ketoreductases.

As used herein, "percentage of sequence homology," "percent homology," and "percent identical" refer to comparisons between polynucleotide sequences or polypeptide sequences, and are determined by comparing two optimally aligned sequences over a comparison window, wherein the portion of the polynucleotide or polypeptide sequence in the comparison window may comprise additions or deletions (i.e., gaps) as compared to the reference sequence for optimal alignment of the two sequences. The percentage is calculated by determining the number of positions at which either the identical nucleic acid base or amino acid residue occurs in both sequences or a nucleic acid base or amino acid residue is aligned with a gap to yield the number of matched positions, dividing the number of matched positions by the total number of positions in the window of comparison and multiplying the result by 100 to yield the percentage of sequence identity. Determination of optimal alignment and percent sequence homology is performed using the BLAST and BLAST 2.0 algorithms (See e.g., Altschul et al., J. Mol. Biol. 215: 403-410 [1990]; and Altschul et al., Nucleic Acids Res. 3389-3402 [1977]). Software for performing BLAST analyses is publicly available through the National Center for Biotechnology Information website.

EXAMPLES

The following examples illustrate the invention without limiting its scope.

Example 1

E. coli Expression Hosts Containing Recombinant KRED Genes

Figure 3:
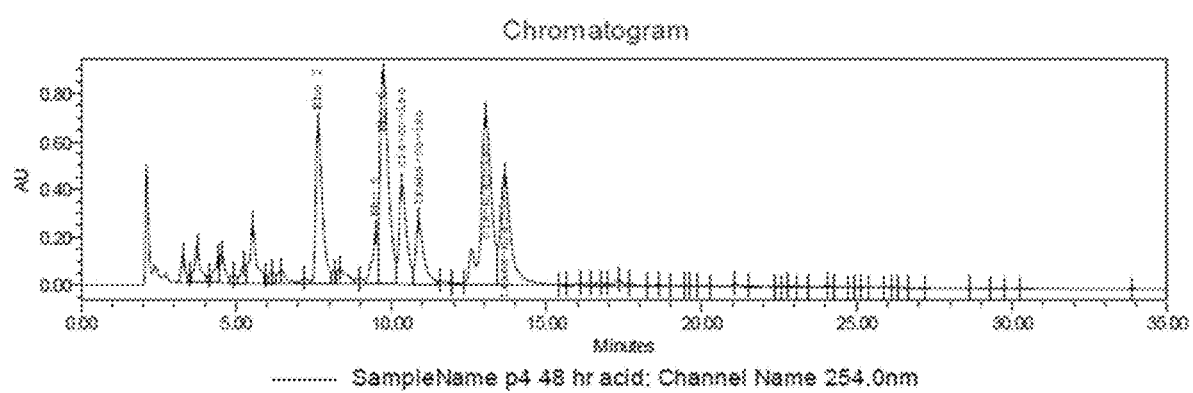
FIG. 3 shows an HPLC chromatogram and peak quantitation for Codexis KRED-P1-B05 (SEQ ID NO: 4) incubated with Isoalpha Acids (acidic solution) for 48 hr at 30° C.

KRED-encoding genes were cloned into the expression vector pCK110900 (See, FIG. 3 of US Pat. Appln. Publn. No. 2006/0195947), operatively linked to the lac promoter under control of the lacI repressor. The expression vector also contains the P15a origin of replication and a chloramphenicol resistance gene. The resulting plasmids were transformed into E. coli W3110, using standard methods known in the art. The transformants were isolated by subjecting the cells to chloramphenicol selection, as known in the art (See e.g., U.S. Pat. No. 8,383,346 and WO2010/144103).

Example 2

Preparation of HTP KRED-Containing Wet Cell Pellets

E. coli cells containing recombinant KRED-encoding genes from monoclonal colonies were inoculated into 190 µl Luria-Bertani (LB) broth containing 1% glucose and 30 µg/mL chloramphenicol in the wells of 96-well shallow-well microtiter plates. The plates were sealed with $O_2$-permeable seals, and cultures were grown overnight at 20° C., 200 rpm, and 85% humidity. Then, 20 µl of each of the cell cultures were transferred into the wells of 96-well deep-well plates containing 380 μL Terrific Broth (TB) and 30 μg/mL chloramphenicol (CAM). The deep-well plates were sealed with $O_2$-permeable seals and incubated at 30° C., 250 rpm, and 85% humidity until an $OD_{600}$ of 0.6-0.8 was reached. The cell cultures were then induced by addition of Isopropyl β-d-1-thiogalactopyranoside (IPTG) to a final concentration of 1 mM and incubated overnight under the same conditions as originally used. The cells were then pelleted using centrifugation at 4° C., 4000 rpm for 10 min. The supernatants were discarded, and the pellets frozen at −80° C. prior to lysis.

Example 3

Preparation of HTP KRED-Containing Cell Lysates

First, the cell pellets that were produced as described in Example 2 were lysed by adding 150 μL lysis buffer containing 100 mM pH 8 triethanolamine*$H_2SO_4$ with 2 mM $MgSO_4$ or 100 mM pH 8 Potassium Phosphate with 2 mM $MgSO_4$, 1 g/L lysozyme, and 0.5 g/L polymixin B sulfate (PMBS). Then, the cell pellets were shaken at room temperature for 2 hours on a bench top shaker. The plates were centrifuged at 4000 rpm, for 15 minutes at 4° C. to remove cell debris. The supernatants were then used in biocatalytic reactions to determine their activity levels.

Example 4

Preparation of Lyophilized Lysates From Shake Flask (SF) Cultures

Shake-flask procedures can be used to generate engineered KRED polypeptide shake-flask powders (SFP), which are useful for secondary screening assays and/or use in the biocatalytic processes described herein. Shake flask powder (SFP) preparation of enzymes provides a more purified preparation (e.g., up to 30% of total protein) of the engineered enzyme, as compared to the cell lysate used in high throughput (HTP) assays and also allows for the use of more concentrated enzyme solutions. To start this, selected HTP cultures grown as described above were plated onto LB agar plates with 1% glucose and 30 μg/ml CAM, and grown overnight at 37° C. A single colony from each culture was transferred to 6 ml of LB with 1% glucose and 30 μg/ml CAM. The cultures were grown for 18 h at 30° C. at 250 rpm, and subcultured approximately 1:50 into 250 ml of TB containing 30 μg/ml CAM, to a final $OD_{600}$ of 0.05. The cultures were grown for approximately 3 hours at 30° C. at 250 rpm to an OD600 between 0.8-1.0 and induced with 1 mM IPTG. The cultures were then grown for 20 h at 30° C. at 250 rpm. The cultures were centrifuged (4000 rpm for 20 min at 4° C.). The supernatant was discarded, and the pellets were re-suspended in 35 ml of 50 mM pH 8 Potassium Phosphate with 2 mM $MgSO_4$. The re-suspended cells were centrifuged (4000 rpm for 20 min at 4° C.). The supernatant was discarded, and the pellets were re-suspended in 6 ml of 50 mM pH 8 Potassium Phosphate with 2 mM $MgSO_4$, and the cells were lysed using a cell disruptor from Constant Systems (One Shot). The lysates were pelleted (10,000 rpm for 60 min at 4° C.), and the supernatants were frozen and lyophilized to generate shake flask (SF) enzymes.

Example 5

Screening of Commercially Available KRED Enzyme Panel

KRED Screening Assay

Figure 4:
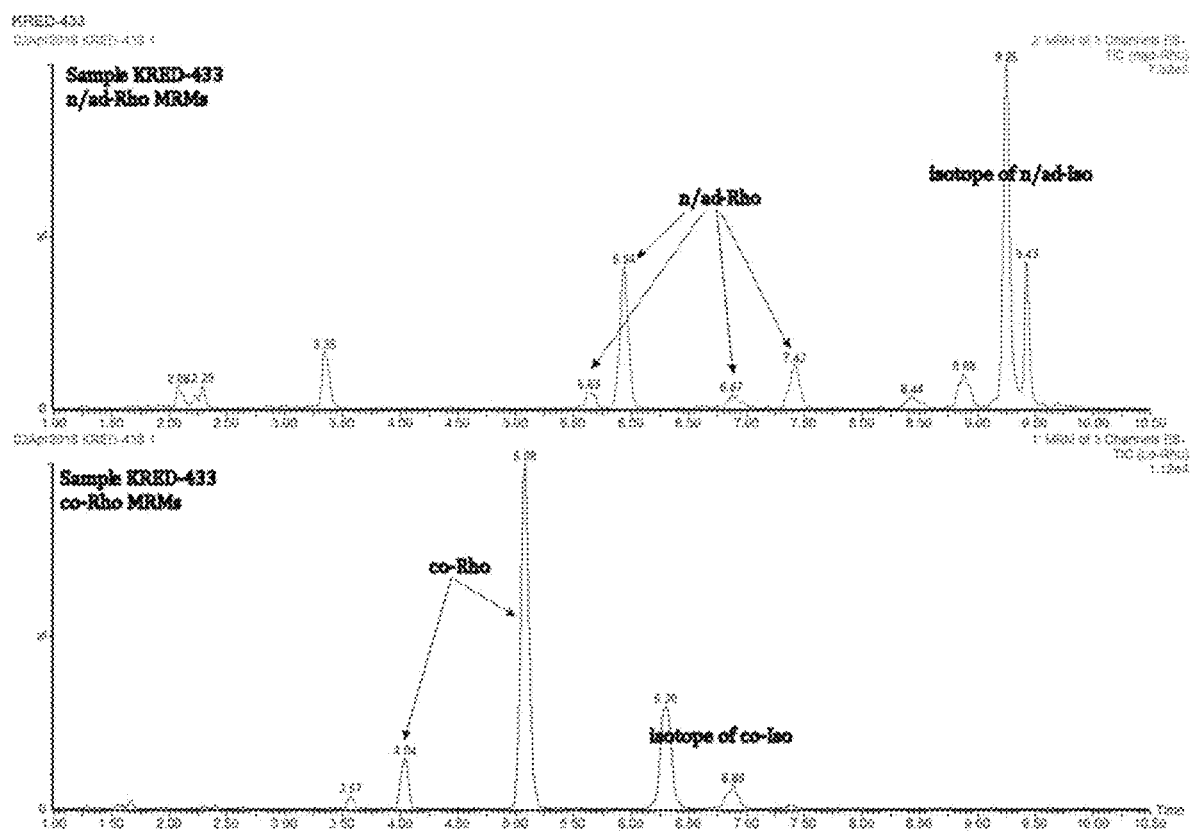
FIG. 4 shows UPLC chromatogram for Codexis KRED-433 incubated with Isoalpha Acids for 24 hr at 30° C.

A set of commercially available ketoreductases were tested for their ability to reduce isoalpha acids using the commercially available "KRED Screening Kits" (Codexis Inc., Redwood City, Calif.). For a portion of the enzymes in this screening, the enzyme assay was carried out in a 1.5 mL volume tubes, in 1000 μL total volume/tube, which included 10 g/L enzyme powder, 2.9 or 6.9 g/L isoalpha acids substrate, and 0.8 g/L NADP in 30 vol % isopropanol (IPA) in 128 mM pH 7 sodium phosphate with 1.7 mM $MgSO_4$. The tubes were closed and incubated at 30° C. with shaking at 180 rpm for 24-48 hours. The obtained reaction mixture was filtered to remove enzyme using a 10,000 MWCO centrifugal filtration device. Isoalpha acids and dihydro-(rho)-isoalpha acids were quantified by UPLC. See, for example, the chromatogram for Codexis KRED-433 presented in FIG. 4.

For the other portion of the enzymes in this screening, the enzyme assay was carried out in a 1.5 mL volume tubes, in 1000 μL total volume/tube, which included 10 g/L enzyme powder, 1.5 g/L isoalpha acids substrate, 0.8 g/L NADP, 0.7 g/L NAD, 14.4 g/L D-glucose, and 4.3 U/mL glucose dehydrogenase in 263 mM pH 7 sodium phosphate with 1.7 mM $MgSO_4$. The tubes were closed and incubated at 30° C. with shaking at 180 rpm for 24-48 hours. The obtained reaction mixture was filtered to remove enzyme using a 10,000 MWCO centrifugal filtration device. Isoalpha acids and dihydro-(rho)-isoalpha acids were quantified by UPLC.

Ketoreductase Characterization Assay

Ketoreductases that produced detectable quantities of dihydro-(rho)-isoalpha acids were further characterized under various reaction conditions. For this purpose, the enzyme assays were carried out in 2.0 mL volume tubes, in 1000 μL total volume/tube, which included 10-20 g/L enzyme powder, 1.5-6.0 g/L isoalpha acids substrate, 0.8 g/L NADP (optionally, 0.7 g/L NAD, 14.4 g/L D-glucose, 4.3 U/mL glucose dehydrogenase or 30 vol % Isopropanol) in 100-263 mM pH 7-9 sodium phosphate (or alternatively, Tris HCl) with 1.7 mM $MgSO_4$. The tubes were closed and incubated at 30-40° C. with shaking at 180 rpm for 24-48 hours. The obtained reaction mixtures were filtered to remove enzyme. Isoalpha acids and dihydro-(rho)-isoalpha acids were detected by UPLC-MS/MS and HPLC.

Results

KRED Screening Results

Several commercially available enzymes from Codexis' "KRED Screening Kits" are capable of reducing isoalpha acids (Table 1). The original kit was composed of 24 ketoreductases (referred to as KREDs) that have been selected (i.e. natural) or engineered for broad substrate range and enhanced activity by the manufacturer. An additional kit was composed of 7 engineered variants based on the backbone of KRED-130.

TABLE 1

Results from Commercially Available KRED Enzyme Panel

| Ketoreductase Enzyme | Rho Detected?[1] |
| --- | --- |
| KRED-P1-A04 | − |
| KRED-P1-A12 | − |
| KRED-P1-B02 | − |
| KRED-P1-B05 | + |
| KRED-P1-B10 | − |
| KRED-P1-B12 | − |
| KRED-P1-C01 | − |
| KRED-P1-H08 | − |
| KRED-P2-B02 | + |
| KRED-P2-C02 | + |

TABLE 1-continued

Results from Commercially Available KRED Enzyme Panel

| Ketoreductase Enzyme | Rho Detected?[1] |
|---|---|
| KRED-P2-C11 | + |
| KRED-P2-D03 | − |
| KRED-P2-D11 | + |
| KRED-P2-D12 | − |
| KRED-P2-G03 | + |
| KRED-P2-H07 | − |
| KRED-P3-B03 | − |
| KRED-P3-G09 | + |
| KRED-P3-H12 | − |
| KRED-101 | + |
| KRED-119 | + |
| KRED-130 | + |
| KRED-NADH-101 | − |
| KRED-NADH-110 | + |
| KRED-430 | + |
| KRED-431 | + |
| KRED-432 | + |
| KRED-433 | + |
| KRED-434 | + |
| KRED-435 | + |
| KRED-436 | + |

[1]+ = Peaks corresponding to Dihydroisoalpha acids (Rho) observed via UPLC-MS after incubation with enzyme.

Ketoreductase Characterization

Enzymes were determined to reduce isoalpha acids if peaks corresponding to cis/trans-co/ad/n-dihydro-(rho)-isoalpha acid were detected via UPLC at a greater intensity than a control sample lacking enzyme.

Figure 2:
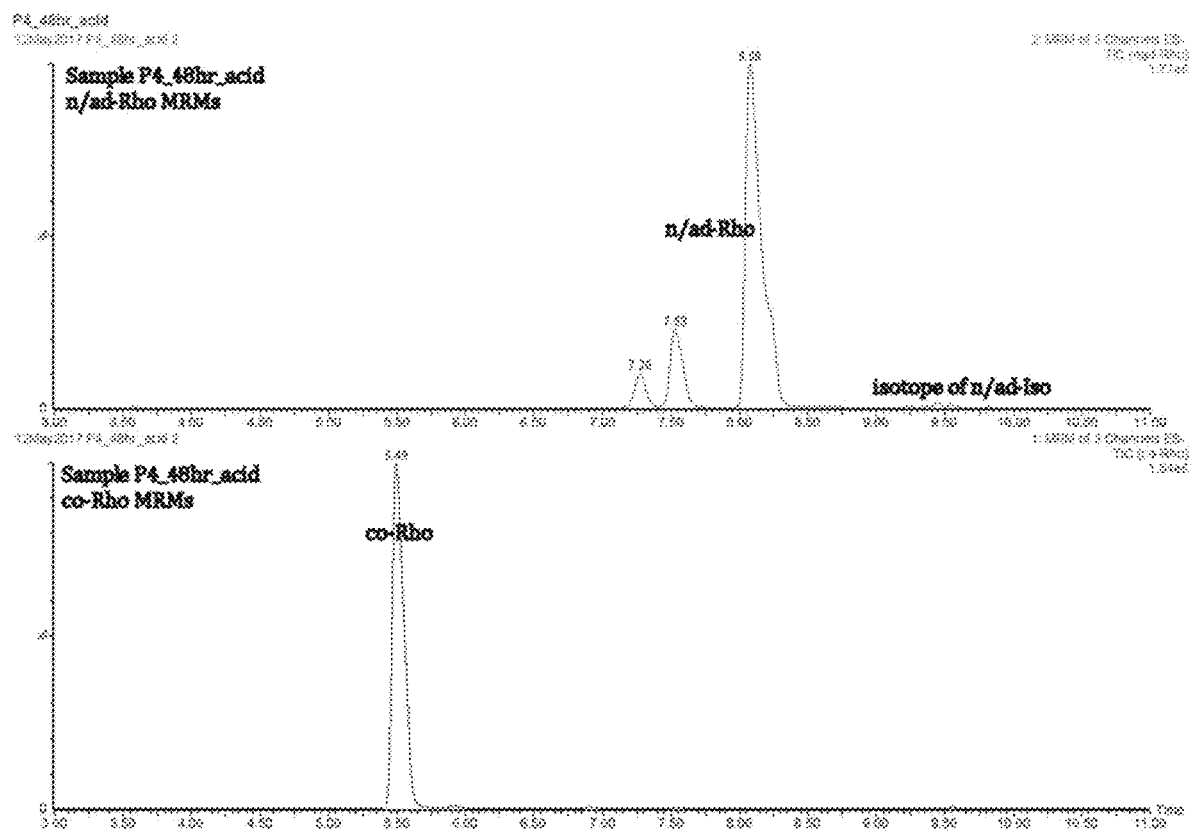
FIG. 2 shows a UPLC chromatogram for Codexis KRED-P1-B05 (SEQ ID NO: 4) incubated with Isoalpha Acids (acidic solution) for 48 hr at 30° C.

KRED-P1-B05 (SEQ ID NO: 4) produced the most dihydro-(rho)-isoalpha acids in a 24 hour period by qualitative comparison of UPLC peak heights (See FIG. 2). KRED-P1-B05 (SEQ ID NO: 4) is derived from an enzyme encoded by a nucleotide (SEQ ID NO: 1) which encodes an amino acid sequence which is a naturally-occurring, wild-type ketoreductase from Lactobacillus kefir (SEQ ID NO: 2). Dihydro-(rho)-isoalpha acids produced by this ketoreductase were present at high enough concentration to be quantified by HPLC. In 24 hour at 30° C., KRED-P1-B05 achieved a yield of 18% dihydro-(rho)-isoalpha acids. The reaction was duplicated with a 48 hour reaction duration, achieving a yield of 42% dihydro-(rho)-isoalpha acids. (See FIG. 3). When the reaction temperature was increased from 30° C. to 37° C. for 48 hours, the yield was 33%.

KRED-P1-B05 activity was initially tested using buffer (128 mM sodium phosphate pH 7 with 1.7 mM magnesium sulfate, 0.8 g/L mM NADP) in addition to 30 vol % isopropanol for cofactor recycling. Multiple reaction conditions (temperature, duration, buffer composition, substrate concentration, etc.) were determined to be adequate for reduction of isoalpha acids.

Substrate Specificity

The ideal ketoreductase for biotransformation purposes shows no substrate specificity for the isohumulone congeners which vary based on side chain composition (conferring n-, ad-, and co-isohumulone). Additionally, the ketoreductase shows no specificity for the isohumulone cis and trans isomers which vary spatially at the C4 tertiary alcohol group proximal to the site of enzymatic reduction. Substrate specificity is dictated by the amino acid sequence and thus the geometry of the substrate binding pocket of an enzyme. Larger binding pockets accommodate larger substrates, as well as a greater variety of substrates, compared to more restricted binding pockets.

Despite the presence of two additional ketone groups on the isoalpha acid molecule, only the desired reduction at the C4 side chain was observed for all characterized ketoreductases.

Example 6

Evolution and Screening of Engineered Polypeptides Derived from SEQ ID NO: 4 for Improved KRED Activity The enzyme of SEQ ID NO: 4 was selected as the parent enzyme based on the results of screening variants for the reduction of the ene-acid substrate. Libraries of engineered genes were produced using well-established techniques (e.g., saturation mutagenesis, and recombination of previously identified beneficial mutations). The polypeptides encoded by each gene were produced in HTP as described in Example 2, and the soluble lysate was generated as described in Example 3.

The engineered polynucleotide of SEQ ID NO: 3 which encodes SEQ ID NO: 4, exhibiting superior KRED activity, was used to generate the further engineered polypeptides of Table 2. These polypeptides displayed improved formation of dihydro-(rho)-isoalpha acids from isoalpha acids, as compared to the starting polypeptide. The engineered polypeptides were generated from the "backbone" amino acid sequence of SEQ ID NO: 4 using directed evolution methods as described above together with the HTP assay and analytical methods described below in Table 2.

TABLE 2

KRED Variant Activity Relative to SEQ ID NO: 4

| SEQ ID NO: (nt/aa) | Percent Conversion Fold Improvement (Relative to SEQ ID NO: 4)[1] |
|---|---|
| 5/6 | ++++ |
| 7/8 | +++ |
| 9/10 | +++ |
| 11/12 | +++ |
| 13/14 | ++ |
| 15/16 | ++ |
| 17/18 | ++ |
| 19/20 | ++ |
| 21/22 | ++ |
| 23/24 | + |
| 25/26 | + |
| 27/28 | + |
| 29/30 | + |
| 31/32 | + |
| 33/34 | + |
| 35/36 | + |
| 37/38 | + |
| 39/40 | + |
| 41/42 | + |
| 43/44 | + |
| 45/46 | + |
| 47/48 | + |
| 49/50 | + |
| 51/52 | + |
| 53/54 | + |
| 55/56 | + |
| 57/58 | + |
| 59/60 | + |
| 61/62 | + |
| 63/64 | + |
| 65/66 | + |
| 67/68 | + |
| 69/70 | + |

[1]Levels of increased activity were determined relative to the reference polypeptide of SEQ ID NO: 4 and defined as follows: "+" > 1.0 but <2.0, "++" ≥ 2 but ≤4, "+++" ≥ 4 but ≤8, "++++" ≥ 8

Directed evolution began with the polynucleotide set forth in SEQ ID NO: 3. Engineered polypeptides were then selected as starting "backbone" gene sequences. Libraries of engineered polypeptides were generated using various well-known techniques (e.g., saturation mutagenesis, recombination of previously identified beneficial amino acid differences) and screened using HTP assay and analysis methods that measured the polypeptides ability to convert the isoalpha acids substrates to the desired dihydro-(rho)-isoalpha acids products.

The enzyme assay was carried out in a 96-well format, in 200 μL total volume/well, which included 50% v/v HTP enzyme lysate, 8 g/L isoalpha acids substrate, and 0.1 g/L NADP in 40 vol % isopropanol (IPA) in 100 mM pH 8 triethanolamine*$H_2SO_4$ with 2 mM $MgSO_4$. The plates were sealed and incubated at 40° C. with shaking at 600 rpm for 20-24 hours.

After 20-24 hours, 1000 μL of acetonitrile with 0.1% acetic acid was added. The plates were sealed and centrifuged at 4000 rpm at 4° C. for 10 min. The quenched sample was further diluted 4-5× in 50:50 acetonitrile:water mixture prior to HPLC analysis. The HPLC run parameters are described below in Table 3.

TABLE 3

HPLC Parameters

| | |
|---|---|
| Instrument | Agilent 1100 HPLC |
| Column | 30 × 50 mm 2.7 μm Waters XBridge Phenyl column |
| Mobile Phase | A: 0.1% acetic acid in water, B: 0.1% acetic acid in acetonitrile |
| Run parameters | 42:58 A/B for 1 minute; ramp to 10:90 A/B over 1 minute |
| Flow Rate | 1.5 mL/min |
| Run time | 2.0 min |

| | Compound | retention time [min] | note |
|---|---|---|---|
| Peak Retention Times | Iso-1 | 0.6 | mixture of co-Iso isomers |
| | Iso-2 | 0.7 | mixture of n/ad-Iso isomers |
| | Iso-3 | 0.8 | mixture of n/ad-Iso isomers |
| | Rho-1 | 1.0 | mixture of co-Rho isomers |
| | Rho-2 | 1.2 | mixture of n/ad-Rho isomers |
| | Rho-3 | 1.4 | mixture of n/ad-Rho isomers |

| | |
|---|---|
| Column Temperature | 50° C. |
| Injection Volume | 10 μL |
| Detection | 260 nm |

Example 7

Evolution and Screening of Engineered Polypeptides Derived from SEQ ID NO: 6 for Improved KRED Activity Libraries of engineered genes were produced using well-established techniques (e.g., saturation mutagenesis, and recombination of previously identified beneficial mutations). The polypeptides encoded by each gene were produced in HTP as described in Example 2, and the soluble lysate was generated as described in Example 3.

The engineered polynucleotide of SEQ ID NO: 5, which encodes the polypeptide of SEQ ID NO: 6, exhibiting superior KRED activity, was used to generate the further engineered polypeptides of Table 4. These polypeptides displayed improved formation of dihydro-(rho)-isoalpha acid from isoalpha acids as compared to the starting polypeptide. The engineered polypeptides were generated from the "backbone" amino acid sequence of SEQ ID NO: 6 using directed evolution methods as described above together with the HTP assay and analytical methods described in Table 3.

TABLE 4

KRED Variant Activity Relative to SEQ ID NO: 6

| SEQ ID NO: (nt/aa) | Percent Conversion Fold Improvement (Relative to SEQ ID NO: 6)[1] |
|---|---|
| 71/72 | ++++ |
| 73/74 | +++ |
| 75/76 | +++ |
| 77/78 | +++ |
| 79/80 | +++ |
| 81/82 | ++ |
| 83/84 | ++ |
| 85/86 | + |
| 87/88 | + |
| 89/90 | + |
| 91/92 | + |
| 93/94 | + |
| 95/96 | + |
| 97/98 | + |

[1]Levels of increased activity were determined relative to the reference polypeptide of SEQ ID NO: 6 and defined as follows: "+" > 1.0 but <2.0, "++" ≥ 2 but ≤4, "+++" ≥ 4 but ≤8, "++++" ≥ 8

Directed evolution began with the polynucleotide set forth in SEQ ID NO: 5. Engineered polypeptides were then selected as starting "backbone" gene sequences. Libraries of engineered polypeptides were generated using various well-known techniques (e.g., saturation mutagenesis, recombination of previously identified beneficial amino acid differences) and screened using HTP assay and analysis methods that measured the polypeptides ability to convert the isoalpha acid substrates to the desired dihydro-(rho)-isoalpha acid products.

The enzyme assay was carried out in a 96-well format, in 200 μL total volume/well, which included 50% v/v HTP enzyme lysate, 16 or 40 g/L of isoalpha acids substrate, and 0.1 g/L NADP in 40 vol % isopropanol (IPA) in 100 mM pH 8 triethanolamine*H2SO4 with 2 mM MgSO4. The plates were sealed and incubated at 40° C. with shaking at 600 rpm for 20-24 hours.

After 20-24 hours, 1000 μL of acetonitrile with 0.1% acetic acid was added. The plates were sealed and centrifuged at 4000 rpm at 4° C. for 10 min. The quenched sample was further diluted 10-20× in 50:50 acetonitrile:water mixture prior to HPLC analysis. The HPLC run parameters are described in Table 3.

Example 8

Evolution and Screening of Engineered Polypeptides Derived from SEQ ID NO: 80 for Improved KRED Activity Libraries of engineered genes were produced using well-established techniques (e.g., saturation mutagenesis, and recombination of previously identified beneficial mutations). The polypeptides encoded by each gene were produced in HTP as described in Example 2, and the soluble lysate was generated as described in Example 3.

The engineered polynucleotide of SEQ ID NO: 79, which encodes the polypeptide of SEQ ID NO: 80, exhibiting superior KRED activity, was used to generate the further engineered polypeptides of Table 5. These polypeptides displayed improved formation of dihydro-(rho)-isoalpha acids from isoalpha acids as compared to the starting polypeptide. The engineered polypeptides were generated from the "backbone" amino acid sequence of SEQ ID NO: 80 using directed evolution methods as described above together with the HTP assay and analytical methods described below in Table 3.

TABLE 5

KRED Variant Activity Relative to SEQ ID NO: 80

| SEQ ID NO: (nt/aa) | Percent Conversion Fold Improvement (Relative to SEQ ID NO: 80)[1] |
|---|---|
| 99/100 | ++++ |
| 101/102 | ++++ |
| 103/104 | +++ |
| 105/106 | +++ |
| 107/108 | +++ |
| 109/110 | +++ |
| 111/112 | +++ |
| 113/114 | ++ |
| 115/116 | ++ |
| 117/118 | ++ |
| 119/120 | ++ |
| 121/122 | ++ |
| 123/124 | ++ |
| 125/126 | ++ |
| 127/128 | ++ |
| 129/130 | + |
| 131/132 | + |
| 133/134 | + |
| 135/136 | + |
| 137/138 | + |
| 139/140 | + |
| 141/142 | + |

Directed evolution began with the polynucleotide set forth in SEQ ID NO: 79. Engineered polypeptides were then selected as starting "backbone" gene sequences. Libraries of engineered polypeptides were generated using various well-known techniques (e.g., saturation mutagenesis, recombination of previously identified beneficial amino acid differences) and screened using HTP assay and analysis methods that measured the polypeptides ability to convert the isoalpha acid substrates to the desired dihydro-(rho)-isoalpha acid products.

The enzyme assay was carried out in a 96-well format, in 200 μL total volume/well, which included 25% v/v HTP enzyme lysate, 60 or 80 g/L of isoalpha acid substrate, and 0.02 g/L NADP in 40 vol % isopropanol (IPA) in 100 mM pH 8 potassium phosphate with 2 mM MgSO$_4$. The plates were sealed and incubated at 45° C. with shaking at 600 rpm for 20-24 hours.

After 20-24 hours, 1000 μL of acetonitrile with 0.1% acetic acid was added. The plates were sealed and centrifuged at 4000 rpm at 4° C. for 10 min. The quenched sample was further diluted 20-40× in 50:50 acetonitrile:water mixture prior to HPLC analysis. The HPLC run parameters are described in Table 3.

Example 9

Evolution and Screening of Engineered Polypeptides Derived From SEQ ID NO: 80 for Improved KRED Activity at High Substrate Concentration Libraries of engineered genes were produced using well-established techniques (e.g., saturation mutagenesis, and recombination of previously identified beneficial mutations). The polypeptides encoded by each gene were produced in HTP as described in Example 2, and the soluble lysate was generated as described in Example 3.

The engineered polynucleotide of SEQ ID NO: 79, which encodes the polypeptide of SEQ ID NO: 80, exhibiting superior KRED activity, was used to generate the further engineered polypeptides of Table 6. These polypeptides displayed improved formation of dihydro-(rho)-isoalpha acids from isoalpha acids as compared to the starting polypeptide. The engineered polypeptides were generated from the "backbone" amino acid sequence of SEQ ID NO: 80 using directed evolution methods as described above and are described below in Table 3.

TABLE 6

KRED Variant Activity Relative to SEQ ID NO: 80

| SEQ ID NO: (nt/aa) | Percent Conversion Fold Improvement (Relative to SEQ ID NO: 80)[1] |
|---|---|
| 143/144 | ++++ |
| 145/146 | ++++ |
| 147/148 | ++++ |
| 149/150 | ++++ |
| 99/100 | ++++ |
| 151/152 | +++ |
| 153/154 | +++ |
| 155/156 | +++ |
| 103/104 | ++ |
| 157/158 | ++ |
| 159/160 | ++ |
| 139/140 | + |
| 161/162 | + |

Directed evolution began with the polynucleotide set forth in SEQ ID NO: 79. Engineered polypeptides were then selected as starting "backbone" gene sequences. Libraries of engineered polypeptides were generated using various well-known techniques (e.g., saturation mutagenesis, recombination of previously identified beneficial amino acid differences) and screened using HTP assay and analysis methods that measured the polypeptides ability to convert the isoalpha acid substrates to the desired dihydro-(rho)-isoalpha acid products.

The enzyme assay was carried out in a 96-well format, in 200 μL total volume/well, which included 10-20% v/v HTP enzyme lysate, 80 or 160 g/L of isoalpha acid substrate, and 0.02 g/L NADP in 40 vol % isopropanol (IPA) in 100 mM pH 8 potassium phosphate with 2 mM MgSO$_4$. The plates were sealed and incubated at 45° C. with shaking at 600 rpm for 20-24 hours.

After 20-24 hours, 1000 μL of acetonitrile with 0.1% acetic acid was added. The plates were sealed and centrifuged at 4000 rpm at 4° C. for 10 min. The quenched sample was further diluted 20-40× in 50:50 acetonitrile:water mixture prior to HPLC analysis. The HPLC run parameters are described in Table 3.

EXAMPLE 10

Evolution and Screening of Engineered Polypeptides Derived From SEQ ID NO: 80, 104, 100, 136, 116, 132, 162, 150, 152, 144 and 146 for Improved KRED Activity at High Substrate and Low NADP Concentration A 200 g/L enzyme stock solution was prepared by dissolving 100 mg of enzyme powder in 500 μL of 100 mM pH 8 potassium phosphate buffer with 2 mM MgSO4 and 0.1 g/L of NADP. To a well in a 96 deep-well plate was added 40 μL of the enzyme/NADP stock solution, 80 μL of isopropanol, and 80 μL of 40 wt % aqueous solution of isoalpha acid. The final reaction composition was 40 g/L of enzyme, 160 g/L isoalpha acid, and 0.02 g/L NADP in 40% IPA. The plate was sealed and incubated 40° C. for 24 h and then quenched and analyzed by HPLC-UV. The data are shown in Table 7 and FIG. 5.

TABLE 7

KRED Activity at High Substrate and Low NADPH Concentration

| SEQ ID NO: | % Conversion | | | | | |
|---|---|---|---|---|---|---|
| (nt/aa) | 40 g/L | 20 g/L | 10 g/L | 5 g/L | 2.5 g/L | 1.25 g/L |
| 79/80 | 4.2 | 1.9 | 0.9 | 0.5 | 0.1 | 0.0 |
| 103/104 | 28.2 | 16.5 | 8.7 | 5.2 | 2.2 | 1.2 |
| 99/100 | 23.1 | 11.2 | 6.1 | 3.3 | 1.3 | 0.6 |
| 135/136 | 23.6 | 7.5 | 2.4 | 1.2 | 0.6 | 0.0 |
| 115/116 | 8.5 | 3.2 | 1.2 | 0.7 | 0.2 | 0.0 |
| 131/132 | 5.3 | 2.2 | 0.8 | 0.4 | 0.1 | 0.0 |
| 161/162 | 29.1 | 14.4 | 5.6 | 2.1 | 0.7 | 0.3 |
| 149/150 | 29.0 | 14.9 | 6.0 | 2.4 | 1.0 | 0.2 |
| 151/152 | 30.6 | 17.9 | 7.4 | 3.6 | 2.0 | 1.2 |
| 143/144 | 29.1 | 14.4 | 5.8 | 2.4 | 1.2 | 0.4 |
| 145/146 | 24.3 | 12.3 | 4.7 | 1.9 | 0.8 | 0.1 |
| 157/158 | 3.0 | 1.1 | 0.4 | 0.0 | 0.0 | 0.0 |

Example 11

Enzyme Treatment of Acidified Hop Derived Isoalpha Acids with Cofactor Recycling by Isopropanol Oxidation Isoalpha acids are treated in a manner described in Example 10, where the source of isoalpha acids is a highly concentrated material (68.9% isoalpha acids) having a pH<7.

Example 12

Enzyme Treatment of Hop Derived Isoalpha Acids With Cofactor Recycling by Glucose Dehydrogenase Isoalpha acids are treated in a manner described in Example 10, with the exception that isopropanol is replaced with 4.3 U/mL Glucose Dehydrogenase, 0.7 g/L mM NAD, and 14.4 g/L D-glucose.

Example 13

Enzyme Treatment of Hop Derived Isoalpha Acids Without Cofactor Recycling

Isoalpha acids are treated in a manner described in Example 10, with the exception that isopropanol is replaced with an equimolar amount of NADPH as substrate.

Example 14

Enzyme Treatment of Hop Derived Isoalpha Acids With Cofactor Recycling by Ethanol Oxidation Isoalpha acids are treated in a manner described in Example 10, with the exception that isopropanol is replaced with ethanol.

Example 15

Enzyme Treatment of Hop Derived Isoalpha Acids With Immobilized Ketoreductase via $SiO_2$ A ketoreductase is adsorbed on $SiO_2$ and crosslinked with glutaraldehyde to yield an immobilized ketoreductase material. Isoalpha acids are treated with the immobilized ketoreductase in a manner described in Example 10. The obtained reaction mixture is centrifuged at 10,000 g to remove immobilized enzyme.

Example 16

Enzyme Treatment of Hop Derived Isoalpha Acids With Immobilized Ketoreductase Via DEAE-Cellulose A ketoreductase is crosslinked with glutaraldehyde and adsorbed onto DEAE-cellulose to yield an immobilized ketoreductase material. Isoalpha acids are treated with the immobilized ketoreductase in a manner described in Example 10. The obtained reaction mixture is centrifuged at 10,000 g to remove immobilized enzyme.

Example 17

Enzyme Treatment of Hop Derived Isoalpha Acids With Immobilized Ketoreductase via PEI-Treated Alumina A ketoreductase is crosslinked with glutaraldehyde and adsorbed onto polyethylimine (PEI)-treated alumina to yield an immobilized ketoreductase material. Isoalpha acids are treated with the immobilized ketoreductase in a manner described in Example 10. The obtained reaction mixture is centrifuged at 10,000 g to remove immobilized enzyme.

Example 18

Enzyme Treatment of Hop Derived Isoalpha Acids With NADH Cofactor Recycling

Enzyme treatment where the NADPH cofactor is substituted with NADH. Isoalpha acids are treated in a manner described in Example 10 but the NADP is replaced with NAD.

Example 19

Enzyme Treatment of Hop Derived Isoalpha Acids Followed by Extraction

Enzyme treatment followed by extraction to increase final concentration of dihydro-(rho)-isoalpha acids is performed. Isoalpha acids are treated in a manner described in Example 10. The obtained reaction mixture is filtered to remove enzyme and extracted with food-grade solvent to achieve a desired concentration of dihydro-(rho)-isoalpha acids.

Example 20

Enzyme Treatment of Hop Derived Isoalpha Acids Followed by Thermal Inactivation

Isoalpha acids are treated in a manner described in Example 10. The reaction is incubated at 30° C. with orbital shaking at 180 rpm for 24 hours. The obtained reaction mixture is heated at 80-100° C. for 10-30 minutes to inactivate enzyme.

Example 21

Enzyme Treatment of Hop Derived Isoalpha Acids Followed by Chemical Inactivation Isoalpha acids are treated in a manner described in Example 10. The reaction is incubated at 30° C. with orbital shaking at 180 rpm for 24 hours. Food-grade ethanol is added to a final concentration of >50% to inactivate enzyme.

Example 22

Enzyme Treatment of Hop Derived Isoalpha Acids With Immobilized Ketoreductase Recycling A ketoreductase is crosslinked with glutaraldehyde and adsorbed onto DEAE-cellulose to yield an immobilized ketoreductase material. Isoalpha acids are then treated with the immobilized ketoreductase in a manner described in Example 10. The obtained reaction mixture is centrifuged at 10,000 g to separate immobilized ketoreductase from the reaction solution. Immobilized ketoreductase is recovered, washed with water or aqueous buffer, and re-used in a new reaction mixture.

Example 23

Isoalpha Acids Reduction Using Engineered Polypeptides Derived From SEQ ID NO: 80, 104, 172, 186, 194, 196, 252, 270, 272, 286, 300, 328, 330, and 346 at High Substrate and Low NADP Concentration Libraries of engineered genes were produced using well-established techniques (e.g., saturation mutagenesis, and recombination of previously identified beneficial mutations). The polypeptides encoded by each gene were produced in HTP as described in Example 2, and the soluble lysate was generated as described in Example 3e.

The engineered polynucleotide of SEQ ID NO: 103, which encodes the polypeptide of SEQ ID NO: 104, exhibiting superior KRED activity, was used to generate the further engineered polypeptides of Table 8. These polypeptides displayed improved formation of dihydro-(rho)-isoalpha acid from isoalpha acids as compared to the starting polypeptide. The engineered polypeptides were generated from the "backbone" amino acid sequence of SEQ ID NO: 104 using directed evolution methods as described above together with the HTP assay and analytical methods described in Table 3.

The following procedure can use any of the improved variants (SEQ ID NO: 6, SEQ ID NO: 80, SEQ ID NO: 104, SEQ ID NO: 172, SEQ ID NO: 186, SEQ ID NO: 194, SEQ ID NO: 196, SEQ ID NO: 252, SEQ ID NO: 270, SEQ ID NO: 272, SEQ ID NO: 286, SEQ ID NO: 300, SEQ ID NO: 328, SEQ ID NO: 330, SEQ ID NO: 346, SEQ ID NO: 348, SEQ ID NO: 356, SEQ ID NO: 414, and SEQ ID NO: 416) for production of enzymatically reduced isoalpha acids at commercially viable isoalpha acids concentrations (volumetric productivity) and % conversion (yield). The reaction is performed in a glass vessel, temperature controlled, with mixing. The data are shown in Table 8 and FIG. 6.

Reagents
a. Isoalpha acids:
  i. Loading is (up to) 160 g/L; 46.000.318; Lot 1014038
  ii. Isoalpha is in the base form (38% by HPLC);
  iii. Use 4210.5 grams
b. Isopropanol (40% by volume)
c. RO water
d. KRED Enzyme (loading is 10 g/L): 100 grams
e. NADP (loading is 0.125 g/L): 1.25 grams
f. Magnesium sulfate heptahydrate (91.615, 1 mM in solution; 0.246 g/L; MW=246.4 g/mole): use 2.46 grams
g. 15% potassium hydroxide (15% KOH)
Procedure
a. Measure out the 40% by volume of water
b. Measure out the 40% by volume of isopropanol
c. Prepare Isoalpha acid solution by adding 15% KOH to pH 8.5 (+/−0.5)
d. Prepare a 10% "solution" of enzyme-NADP-magnesium sulfate heptahydrate in water
e. Add enzyme solution to isoalpha acid to start reaction.
f. Heat reaction to 40° C.
g. Purge vessel with nitrogen.
h. Reaction is sampled and pH is recorded at time 0, 24 and 48 hours.

TABLE 8

KRED Variant Activity Relative to SEQ ID NO: 104

| SEQ ID NO: (nt/aa) | Percent Conversion Fold Improvement (Relative to SEQ ID NO: 104)[1] |
|---|---|
| 413/414 | ++++ |
| 415/416 | ++++ |
| 355/356 | ++++ |
| 329/330 | ++++ |
| 327/328 | ++++ |
| 285/286 | ++++ |
| 271/272 | +++ |
| 269/270 | +++ |
| 251/252 | +++ |
| 193/194 | +++ |
| 185/186 | ++ |
| 171/172 | + |

[1]Levels of increased activity were determined relative to the reference polypeptide of SEQ ID NO: 104 and defined as follows: "+" > 1.0 but <10.0, "++" ≥ 10 but ≤20, "+++" ≥ 20 but ≤50, "++++" ≥ 50

Example 24

Isoalpha Acids Reduction Using Engineered Polypeptides Derived From SEQ ID NO: 414 and 416 at Higher Substrate Concentration Isoalpha acids are treated in a manner described in Example 23, but where the concentration of isoalpha acids present in the reaction can be increased up to 20% w/v.

Conclusions 208 ketoreductases have been characterized as transforming isoalpha acids into dihydro-(rho)-isoalpha acids. The ketoreductases characterized in this study possess an enzymatic activity that has not been described previously. The ketoreductases characterized in this study all reduce a ketone group into an alcohol and are thus ketoreductases. These results demonstrate that a ketoreductase biocatalyst may be employed to convert isoalpha acids to dihydro-(rho)-isoalpha acids in a novel biotransformation process. The present invention is intended to replace current processes utilizing sodium borohydride.

CITED REFERENCES

1. Sodium Borohydride; MSDS No. S9125; Sigma-Aldrich Co.: Saint Louis, Mo. Nov. 1, 2015. (accessed Jun. 8, 2017).
2. Robinson, P. K., Enzymes: principles and biotechnological applications. Essays Biochem 2015, 59, 1-41.
3. Hult, K.; Berglund, P., Enzyme promiscuity: mechanism and applications. Trends Biotechnol. 2007, 25 (5), 231-238.
4. Nobeli, I.; Favia, A. D.; Thornton, J. M., Protein promiscuity and its implications for biotechnology. Nat. Biotechnol. 2009, 27 (2), 157-167.
5. Pozen, M., Enzymes in Brewing. Ind. Eng. Chem, 1934, 26 (11), 1127-1133.
6. Praet, T.; Opstaele, F.; Jaskula-Goiris, B.; Aerts, G.; De Cooman, L., Biotransformations of hop-derived aroma compounds by *Saccharomyces cerevisiae* upon fermentation. Cerevisia, 2012, 36, 125-132.
7. Wallerstein, L. (1947) Bentonite and Proteolytic Enzyme Treatment of Beer, U.S. Pat. No. 2,433,411.
8. Ghionno, L.; Marconi, O.; Sileoni, V.; De Francesco, G.; Perretti, G., Brewing with prolyl endopeptidase from *Aspergillus niger* the impact of enzymatic treatment on gluten levels, quality attributes, and sensory profile. Int. J. Food Sci. Technol, 2017, 52 (6), 1367-1374.
9. Gros, J.; Tran, T. T. H.; Collin, S., Enzymatic release of odourant polyfunctional thiols from cysteine conjugates in hop. J. Inst. Brew. 2013, 119 (4), 221-227.

SEQUENCE LISTING (416 sequences)

SEQ ID NO: 1 - DNA, 759 bp, Artificial Sequence
  Wild-Type Kred from Lactobacillus kefir
atgaccgatcgtctgaagggcaaagtagccatcgtaaccggcgggactctgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcatccgatgaagcaggctggacgaaactgttcgacaccaccgaggaggcattcggcccggttacgaccgtcgtgaacaatgcagggattgcagtttccaaaagcgttgaagacactaccacggaggaatggcgtaaactgctgtccgttaatctggatggtgtttttttcggcacccgtctgggcattcagcgcatgaaaaataaaggcttgggcgctagcatcatcaatatgagcagtattgaggggttcgtaggcgatccgacgctgggggcatacaacgcttccaagggggcggtacgtatcatgtcgaaaagcgcagcgctggattgcgcactgaaggactacgatgtgcgtgtcaacacagtacatccgggctatatcaagaccccgctggtcgatgatctggaaggtgctgaggaaatgatgtcacagcgtacgaaaacccctatgggccacattggcgaaccgaatgacatcgcatggatctgtgtgtacctggcatctgacgaatcgaaatttgcgacgggtgcagaatttgtggtcgacggcgggtataccgcacagtga

SEQ ID NO: 2 - protein, 252 aa, Artificial Sequence
  Wild Type Kred from Lactobacillus kefir
MTDRLKGKVAIVTGGTLGIGLAIADKFVEEGAKVVITGRHADVGEKAAKSIGGTDVIRFVQHDASDEAGWTKLFDTTEEAFGPVTTVVNNAGIAVSKSVEDTTTEEWRKLLSVNLDGVFFGTRLGIQRMKNKGLGASIINMSSIEGFVGDPTLGAYNASKGAVRIMSKSAALDCALKDYDVRVNTVHPGYIKTPLVDDLEGAEEMMSQRTKTPMGHIGEPNDIAWICVYLASDESKFATGAEFVVDGGYTAQ

SEQ ID NO: 3 - DNA, 759 bp, Artificial Sequence
  Engineered Variant of Kred from Lactobacillus kefir
atgaccgatcgtctgaagcataaagtagccatcgtaaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccgtcgtgaacaatgcagggattggggttattaaaagcgttgaagacactaccacggaggaatggcgtaaactgctgtccgttaatctggatggtgtttttttcggcacccgtctgggcattcagcgcatgaaaaataaaggcttgggcgctagcatcatcaatatgagcagtattctggggctcgtaggcgatccgacgctgggggcatacaacgcttccaagggggcggtacgtatcatgtcgaaaagcgcagcgctggattgcgcactgaaggactacgatgtgcgtgtcaacacagtacatccgggccccatcaagaccccgcggctcgatgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacagtga

SEQ ID NO: 4 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTVVNNAGIGVIKSVEDTTTEEWRKLLSVNLDGVFFGTRLGIQRMKNKGLGASIINMSSILGLVGDPTLGAYNASKGAVRIMSKSAALDCALKDYDVRVNTVHPGPIKTPRLDDLEGWEEMMSQRTLTPMGHIGEPNDIAWICVYLASDESKFATGAEFVVDGGWTAQ

SEQ ID NO: 5 - DNA, 756 bp, Artificial Sequence
  Engineered Variant of Kred from Lactobacillus kefir
atgaccgatcgtctgaagcataaagtagccatcgtaaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccgtcgtgaacaatgcagggattggggttattaaaagcgttgaagacactaccacggaggaatggcgtaaactgctgtccgttaatctggatggtgtttttttcggcacccgtctgggcattcagcgcatgaaaaataaaggcttgggcgctagcatcatcaatatgagcagtattctggggctcgtaggcgatccgacgctgggggcatacaacgcttccaagggggcggtacgtatcatgtcgaaaagcgcagcgctggattgcgcactgaaggactacgatgtgcgtgtcaacacagtacatccgggccccatcaagaccccgcggaaggatgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 6 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTVVNNAGIGVIKSVEDTTTEEWRKLLSVNLDGVFFGTRLGIQRMKNKGLGASIINMSSILGLVGDPTLGAYNASKGAVRIMSKSAALDCALKDYDVRVNTVHPGPIKTPRKDDLEGWEEMMSQRTLTPMGHIGEPNDIAWICVYLASDESKFATGAEFVVDGGWTAQ

SEQ ID NO: 7 - DNA, 756 bp, Artificial Sequence
  Engineered Variant of Kred from Lactobacillus kefir
atgaccgatcgtctgaagcataaagtagccatcgtaaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccgtcgtgaacaatgcagggattggggttattaaaagcgttgaagacactaccacggaggaatggcgtaaactgctgtccgttaatctggatggtgtttttttcggcacccgtctgggcattcagcgcatgaaaaataaaggcttgggcgctagcatcatcaatatgagcagtattctggggctcgtaggcgatccgacgctgggggcatacaacgcttccaagggggcggtacgtatcatgtcgaaaagcgcagcgctggattgcgcactgaaggactacgatgtgcgtgtcaacacagtacatccgggccccatcaagaccccgcggagggatgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 8 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTVVNNAGIGVIKSVEDTTTEEWRKLLSVNLDGVFFGTRLGIQRMKNKGLGASIINMSSILGLVGDPTLGAYNASKGAVRIMSKSAALDCALKDYDVRVNTVHPGPIKTPRRDDLEGWEEMMSQRTLTPMGHIGEPNDIAWICVYLASDESKFATGAEFVVDGGWTAQ

SEQ ID NO: 9 - DNA, 756 bp, Artificial Sequence
  Engineered Variant of Kred from Lactobacillus kefir
atgaccgatcgtctgaagcataaagtagccatcgtaaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccgtcgtgaacaatgcagggattggggttattaaaagcgttgaagacactaccacggaggaatggcgtaaactgctgtccgttaatctggatggtgtttttttcggcacccgtctgggcattcagcgcatgaaaaataaaggcttgggcgctagcatcatcaatatgagcagtattctggggctcgtaggcgatccgacgaggggggcatacaacgcttccaagggggcggtacgtatcatgtcgaaaagcgcagcgctggattgcgcactgaaggactacgatgtgcgtgtcaacacagtacatccgggccccatcaagaccccgcggctcgatgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 10 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTVVNNAGIGVIKSVEDTTTEEWRKLLSVNLDGVFFGTRLGIQRMKNKGLGASIINMSSILGLVGDPTRGAYNASKGAVRIMSKSAALDCALKDYDVRVNTVHPGPIKTPRLDDLEGWEEMMSQRTLTPMGHIGEPNDIAWICVYLASDESKFATGAEFVVDGGWTAQ

SEQ ID NO: 11 - DNA, 756 bp, Artificial Sequence
  Engineered Variant of Kred from Lactobacillus kefir
atgaccgatcgtctgaagcataaagtagccatcgtaaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccgtcgtgaacaatgcagggattggggttattaaaagcgttgaagacactaccacggaggaatggcgtaaactgctgtccgttaatctggatggtgtttttttcggcacccgtctgggcattcagcgcatgaaaaataaaggcttgggcgctagcatcatcaatatgagcagtatttctgggctcgtaggcgatccgacgctgggggcatacaacgcttccaagggggcggtacgtatcatgtcgaaaagcgcagcgctggattgcgcactgaaggactacgatgtgcgtgtcaacacagtacatccgggccccatcaagaccccgcggctcgatgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 12 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTVVNNAGIGVIKSVEDTTTEEWRKLLSVNLDGVFFGTRLGIQRMKNKGLGASIINMSSISGLVGDPTLGAYNASKGAVRIMSKSAALDCALKDYDVRVNTVHPGPIKTPRLDDLEGWEEMMSQRTLTPMGHIGEPNDIAWICVYLASDESKFATGAEFVVDGGWTAQ

SEQ ID NO: 13 - DNA, 756 bp, Artificial Sequence
  Engineered Variant of Kred from Lactobacillus kefir
atgaccgatcgtctgaagcataaagtagccatcgtaaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccgtcgtgaacaatgcagggattggggttattaaaagcgttgaagacactaccacggaggaatggcgtaaactgctgtccgttaatctggatggtgtttttttcggcacccgtctgggcattcagcgcatgaaaaataaaggcttgggcgctagcatcatcaatatgagcagtattctggggctcgtaggcgatccgggtctgggggcatacaacgcttccaagggggcggtacgtatcatgtcgaaaagcgcagcgctggattgcgcactgaaggactacgatgtgcgtgtcaacacagtacatccgggccccatcaagaccccgcggctcgatgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 14 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTVVNNAGIGVIKSVEDTTTEEWRKLLSVNLDGVFFGTRLGIQRMKNKGLGASIINMSSILGLVGDPGLGAYNASKGAVRIMSKSAALDCALKDYDVRVNTVHPGPIKTPRLDDLEGWEEMMSQRTLTPMGHIGEPNDIAWICVYLASDESKFATGAEFVVDGGWTAQ

SEQ ID NO: 15 - DNA, 756 bp, Artificial Sequence
  Engineered Variant of Kred from Lactobacillus kefir
atgaccgatcgtctgaagcataaagtagccatcgtaaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccgtcgtgaacaatgcagggattggggttattaaaagcgttgaagacactaccacggaggaatggcgtaaactgctgtccgttaatctggatggtgtttttttcggcacccgtctgggcattcagcgcatgaaaaataaaggcttgggcgctagcatcatcaatatgagcagtattctggggctcgtaggcgatccgacgctgggggcatacaacgcttccaagggggcggtacgtatcatgtcgaaaagcgcagcgctggattgcgcactgaaggactacgatgtgcgtgtcaacacagtacatccgggccccatcaagaccccgcggcatgatgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 16 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTVVNNAGIGVIKSVEDTTTEEWRKLLSVNLDGVFFGTRLGIQRMKNKGLGASIINMSSILGLVGDPTLGAYNASKGAVRIMSKSAALDCALKDYDVRVNTVHPGPIKTPRHDDLEGWEEMMSQRTLTPMGHIGEPNDIAWICVYLASDESKFATGAEFVVDGGWTAQ

SEQ ID NO: 17 - DNA, 756 bp, Artificial Sequence
  Engineered Variant of Kred from Lactobacillus kefir
atgaccgatcgtctgaagcataaagtagccatcgtaaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccgtcgtgaacaatgcaggggttggggttattaaaagcgttgaagacactaccacggaggaatggcgtaaactgctgtccgttaatctggatggtgtttttttcggcacccgtctgggcattcagcgcatgaaaaataaaggcttgggcgctagcatcatcaatatgagcagtattctggggctcgtaggcgatccgacgctgggggcatacaacgcttccaagggggcggtacgtatcatgtcgaaaagcgcagcgctggattgcgcactgaaggactacgatgtgcgtgtcaacacagtacatccgggccccatcaagaccccgcggctcgatgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 18 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTVVNNAGVGVIKSVEDTTTEEWRKLLSVNLDGVFFGTRLGIQRMKNKGLGASIINMSSILGLVGDPTLGAYNASKGAVRIMSKSAALDCALKDYDVRVNTVHPGPIKTPRLDDLEGWEEMMSQRTLTPMGHIGEPNDIAWICVYLASDESKFATGAEFVVDGGWTAQ

SEQ ID NO: 19 - DNA, 756 bp, Artificial Sequence
  Engineered Variant of Kred from Lactobacillus kefir
atgaccgatcgtctgaagcataaagtagccatcgtaaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccgtcgtgaacaatgcagggattggggttattaaaagcgttgaagacactaccacggaggaatggcgtaaactgctgtccgttaatctggatggtgtttttttcggcacccgtctgggcattcagcgcatgaaaaataaaggcttgggcgctagcatcatcaatatgagcagtattatggggctcgtaggcgatccgacgctgggggcatacaacgcttccaagggggcggtacgtatcatgtcgaaaagcgcagcgctggattgcgcactgaaggactacgatgtgcgtgtcaacacagtacatccgggccccatcaagaccccgcggctcgatgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 20 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTVVNNAGIGVIKSVEDTTTEEWRKLLSVNLDGVFFGTRLGIQRMKNKGLGASIINMSSIMGLVGDPTLGAYNASKGAVRIMSKSAALDCALKDYDVRVNTVHPGPIKTPRLDDLEGWEEMMSQRTLTPMGHIGEPNDIAWICVYLASDESKFATGAEFVVDGGWTAQ

SEQ ID NO: 21 - DNA, 756 bp, Artificial Sequence
  Engineered Variant of Kred from Lactobacillus kefir
atgaccgatcgtctgaagcataaagtagccatcgtaaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccgtcgtgaacaatgcagggattggggttattaaaagcgttgaagacactaccacggaggaatggcgtaaactgctgtccgttaatctggatggtgtttttttcggcacccgtctgggcattcagcgcatgaaaaataaaggcttgggcgctagcatcatcaatatgagcagtattggtgggctcgtaggcgatccgacgctgggggcatacaacgcttccaagggggcggtacgtatcatgtcgaaaagcgcagcgctggattgcgcactgaaggactacgatgtgcgtgtcaacacagtacatccgggccccatcaagaccccgcggctcgatgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 22 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTVVNNAGIGVIKSVEDTTTEEWRKLLSVNLDGVFFGTRLGIQRMKNKGLGASIINMSSIGGLVGDPTLGAYNASKGAVRIMSKSAALDCALKDYDVRVNTVHPGPIKTPRLDDLEGWEEMMSQRTLTPMGHIGEPNDIAWICVYLASDESKFATGAEFVVDGGWTAQ

SEQ ID NO: 23 - DNA, 756 bp, Artificial Sequence
  Engineered Variant of Kred from Lactobacillus kefir
atgaccgatcgtctgaagcataaagtagccatcgtaaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccgtcgtgaacaatgcagggattggggttattaaaagcgttgaagacactaccacggaggaatggcgtaaactgctgtccgttaatctggatggtgtttttttcggcacccgtctgggcattcagcgcatgaaaaataaaggcttgggcgctagcatcatcaatatgagcagtatttgtgggctcgtaggcgatccgacgctgggggcatacaacgcttccaagggggcggtacgtatcatgtcgaaaagcgcagcgctggattgcgcactgaaggactacgatgtgcgtgtcaacacagtacatccgggccccatcaagaccccgcggctcgatgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 24 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTVVNNAGIGVIKSVEDTTTEEWRKLLSVNLDGVFFGTRLGIQRMKNKGLGASIINMSSICGLVGDPTLGAYNASKGAVRIMSKSAALDCALKDYDVRVNTVHPGPIKTPRLDDLEGWEEMMSQRTLTPMGHIGEPNDIAWICVYLASDESKFATGAEFVVDGGWTAQ

SEQ ID NO: 25 - DNA, 756 bp, Artificial Sequence
  Engineered Variant of Kred from Lactobacillus kefir
atgaccgatcgtctgaagcataaagtagccatcgtaaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccgtcgtgaacaatgcagggattggggttattaaaagcgttgaagacactaccacggaggaatggcgtaaactgctgtccgttaatctggatggtgtttttttcggcacccgtctgggcattcagcgcatgaaaaataaaggcttgggcgctagcatcatcaatatgagcagtattctggggctcgtaggcgatccgacggttggggcatacaacgcttccaagggggcggtacgtatcatgtcgaaaagcgcagcgctggattgcgcactgaaggactacgatgtgcgtgtcaacacagtacatccgggccccatcaagaccccgcggctcgatgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 26 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTVVNNAGIGVIKSVEDTTTEEWRKLLSVNLDGVFFGTRLGIQRMKNKGLGASIINMSSILGLVGDPTVGAYNASKGAVRIMSKSAALDCALKDYDVRVNTVHPGPIKTPRLDDLEGWEEMMSQRTLTPMGHIGEPNDIAWICVYLASDESKFATGAEFVVDGGWTAQ

SEQ ID NO: 27 - DNA, 756 bp, Artificial Sequence
  Engineered Variant of Kred from Lactobacillus kefir
atgaccgatcgtctgaagcataaagtagccatcgtaaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccgtcgtgaacaatgcagggattggggttattaaaagcgttgaagacactaccacggaggaatggcgtaaactgctgtccgttaatctggatggtgtttttttcggcacccgtctgggcattcagcgcatgaaaaataaaggcttgggcgctagcatcatcaatatgagcagtattctggggctcgtaggcgatccgacgctgggggcatacaacgcttccaagggggcggtacgtatcatgtcgaaaagcgcagcgctggattgcgcactgaaggactacgatgtgcgtgtcaacacagtacatccgggccccatcaagaccccgcggctcagggatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 28 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTVVNNAGIGVIKSVEDTTTEEWRKLLSVNLDGVFFGTRLGIQRMKNKGLGASIINMSSILGLVGDPTLGAYNASKGAVRIMSKSAALDCALKDYDVRVNTVHPGPIKTPRLRDLEGWEEMMSQRTLTPMGHIGEPNDIAWICVYLASDESKFATGAEFVVDGGWTAQ

SEQ ID NO: 29 - DNA, 756 bp, Artificial Sequence
  Engineered Variant of Kred from Lactobacillus kefir
atgaccgatcgtctgaagcataaagtagccatcgtaaccggcgggacactgggtatcggtagggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccgtcgtgaacaatgcagggattggggttattaaaagcgttgaagacactaccacggaggaatggcgtaaactgctgtccgttaatctggatggtgtttttttcggcacccgtctgggcattcagcgcatgaaaaataaaggcttgggcgctagcatcatcaatatgagcagtattctggggctcgtaggcgatccgacgctgggggcatacaacgcttccaagggggcggtacgtatcatgtcgaaaagcgcagcgctggattgcgcactgaaggactacgatgtgcgtgtcaacacagtacatccgggccccatcaagaccccgcggctcgatgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 30 - protein, 252 aa, Artificial Sequence
  Engineered Variant of Kred from Lactobacillus kefir
MTDRLKHKVAIVTGGTLGIGRAIADKFVEEGAKVVITGRHADVGEKAAKSIGGTDVIRFVQHDASEEAGWTKLFDTTEEAFGPVTTVVNNAGIGVIKSVEDTTTEEWRKLLSVNLDGVFFGTRLGIQRMKNKGLGASIINMSSILGLVGDPTLGAYNASKGAVRIMSKSAALDCALKDYDVRVNTVHPGPIKTPRLDDLEGWEEMMSQRTLTPMGHIGEPNDIAWICVYLASDESKFATGAEFVVDGGWTAQ

SEQ ID NO: 31 - DNA, 756 bp, Artificial Sequence
  Engineered Variant of Kred from Lactobacillus kefir
atgaccgatcgtctgaagcataaagtagccatcgtaaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccgtcgtgaacaatgcaggggatggggttattaaaagcgttgaagacactaccacggaggaatggcgtaaactgctgtccgttaatctggatggtgtttttttcggcacccgtctgggcattcagcgcatgaaaaataaaggcttgggcgctagcatcatcaatatgagcagtattctggggctcgtaggcgatccgacgctgggggcatacaacgcttccaagggggcggtacgtatcatgtcgaaaagcgcagcgctggattgcgcactgaaggactacgatgtgcgtgtcaacacagtacatccgggccccatcaagaccccgcggctcgatgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 32 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTVVNNAGDGVIKSVEDTTTEEWRKLLSVNLDGVFFGTRLGIQRMKNKGLGASIINMSSILGLVGDPTLGAYNASKGAVRIMSKSAALDCALKDYDVRVNTVHPGPIKTPRLDDLEGWEEMMSQRTLTPMGHIGEPNDIAWICVYLASDESKFATGAEFVVDGGWTAQ

SEQ ID NO: 33 - DNA, 756 bp, Artificial Sequence
  Engineered Variant of Kred from Lactobacillus kefir
atgaccgatcgtctgaagcataaagtagccatcgtaaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccgtcgtgaacaatgcagggattggggttattaaaagcgttgaagacactaccacggaggaatggcgtaaactgctgtccgttaatctggatggtgtttttttcggcacccgtctgggcattcagcgcatgaaaaataaaggcttgggcgctagcatcatcaatatgagcagtattctggggctcattggcgatccgacgctgggggcatacaacgcttccaagggggcggtacgtatcatgtcgaaaagcgcagcgctggattgcgcactgaaggactacgatgtgcgtgtcaacacagtacatccgggccccatcaagaccccgcggctcgatgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 34 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTVVNNAGIGVIKSVEDTTTEEWRKLLSVNLDGVFFGTRLGIQRMKNKGLGASIINMSSILGLIGDPTLGAYNASKGAVRIMSKSAALDCALKDYDVRVNTVHPGPIKTPRLDDLEGWEEMMSQRTLTPMGHIGEPNDIAWICVYLASDESKFATGAEFVVDGGWTAQ

SEQ ID NO: 35 - DNA, 756 bp, Artificial Sequence
  Engineered Variant of Kred from Lactobacillus kefir
atgaccgatcgtctgaagcataaagtagccatcgtaaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccgtcgtgaacaatgcagggattggggttattaaaagcgttgaagacactaccacggaggaatggcgtaaactgctgtccgttaatctggatggtgtttttttcggcacccgtctgggcattcagcgcatgaaaaataaaggcttgggcgctagcatcatcaatatgagcagtattctggggctcgtaggcgatccgacgtgtggggcatacaacgcttccaagggggcggtacgtatcatgtcgaaaagcgcagcgctggattgcgcactgaaggactacgatgtgcgtgtcaacacagtacatccgggccccatcaagaccccgcggctcgatgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 36 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTVVNNAGIGVIKSVEDTTTEEWRKLLSVNLDGVFFGTRLGIQRMKNKGLGASIINMSSILGLVGDPTCGAYNASKGAVRIMSKSAALDCALKDYDVRVNTVHPGPIKTPRLDDLEGWEEMMSQRTLTPMGHIGEPNDIAWICVYLASDESKFATGAEFVVDGGWTAQ

SEQ ID NO: 37 - DNA, 756 bp, Artificial Sequence
  Engineered Variant of Kred from Lactobacillus kefir
atgaccgatcgtctgaagcataaagtagccatcgtaaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccgtcgtgaacaatgcagggattggggttattaaaagcgttgaagacactaccacggaggaatggcgtaaactgctgtccgttaatctggatggtgtttttttcggcacccgtctgggcattcagcgcatgaaaaataaaggcttgggcgctagcatcatcaatatgagcagtattctggggctcgtaggcgatccgacgctgggggcatacaacgcttccaagggggcggtacgtatcatgtcgaaaagcgcagcgctggattgcgcactgaaggactacgatgtgcgtgtcaacacagtacatccgggccccatcaagaccccgcggctcgatgatctgcagggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 38 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTVVNNAGIGVIKSVEDTTTEEWRKLLSVNLDGVFFGTRLGIQRMKNKGLGASIINMSSILGLVGDPTLGAYNASKGAVRIMSKSAALDCALKDYDVRVNTVHPGPIKTPRLDDLQGWEEMMSQRTLTPMGHIGEPNDIAWICVYLASDESKFATGAEFVVDGGWTAQ

SEQ ID NO: 39 - DNA, 756 bp, Artificial Sequence
  Engineered Variant of Kred from Lactobacillus kefir
atgaccgatcgtctgaagcataaagtagccatcgtaaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccgtcgtgaacaatgcagggattggggttattaaaagcgttgaagacactaccacggaggaatggcgtaaactgctgtccgttaatctggatggtgtttttttcggcacccgtctgggcattcagcgcatgaaaaataaaggcttgggcgctagcatcatcaatatgagcagtattctggggctcgtaggcgatccgacgctgggggcatacaacgcttccaagggggcggtacgtatcatgtcgaaaagcgcagcgctggattgcgcactgaaggactacgatgtgcgtgtcaacacagtacatccgggccccatcaagaccaggcggctcgatgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 40 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTVVNNAGIGVIKSVEDTTTEEWRKLLSVNLDGVFFGTRLGIQRMKNKGLGASIINMSSILGLVGDPTLGAYNASKGAVRIMSKSAALDCALKDYDVRVNTVHPGPIKTRRLDDLEGWEEMMSQRTLTPMGHIGEPNDIAWICVYLASDESKFATGAEFVVDGGWTAQ

SEQ ID NO: 41 - DNA, 756 bp, Artificial Sequence
  Engineered Variant of Kred from Lactobacillus kefir
atgaccgatcgtctgaagcataaagtagccatcgtaaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccgtcgtgaacaatgcagggattggggttattaaaagcgttgaagacactaccacggaggaatggcgtaaactgctgtccgttaatctggatggtgtttttttcggcacccgtctgggcattcagcgcatgaaaaataaaggcttgggcgctagcatcatcaatatgagcagtattctggggctcgtaggcgatccgacgctgggggcatacaacgcttccaagggggcggtacgtatcatgtcgaaaagcgcagcgctggattgcgcactgaaggactacgatgtgcgtgtcaacacagtacatccgggccccatcaagaccccgcggctcgatgatctgcggggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 42 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTVVNNAGIGVIKSVEDTTTEEWRKLLSVNLDGVFFGTRLGIQRMKNKGLGASIINMSSILGLVGDPTLGAYNASKGAVRIMSKSAALDCALKDYDVRVNTVHPGPIKTPRLDDLRGWEEMMSQRTLTPMGHIGEPNDIAWICVYLASDESKFATGAEFVVDGGWTAQ

SEQ ID NO: 43 - DNA, 756 bp, Artificial Sequence
  Engineered Variant of Kred from Lactobacillus kefir
atgaccgatcgtctgaagcataaagtagccatcgtaaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccgtcgtgaacaatgcagggattggggttattaaaagcgttgaagacactaccacggaggaatggcgtaaactgctgtccgttaatctggatggtgtttttttcggcacccgtctgggcattcagcgcatgaaaaataaaggcttgggcgctagcatcatcaatatgagcagtattctggggctcgtaggcgatccgacgctgggggcatacaacgcttccaagggggcggtacgtatcatgtcgaaaagcgcagcgctggattgcgcactgaaggactacgatgtgcgtgtcaacacagtacatccgggccccatcaagaccccgcggctcgatgatctggaaggttgggaggaaatggtgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 44 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTVVNNAGIGVIKSVEDTTTEEWRKLLSVNLDGVFFGTRLGIQRMKNKGLGASIINMSSILGLVGDPTLGAYNASKGAVRIMSKSAALDCALKDYDVRVNTVHPGPIKTPRLDDLEGWEEMVSQRTLTPMGHIGEPNDIAWICVYLASDESKFATGAEFVVDGGWTAQ

SEQ ID NO: 45 - DNA, 756 bp, Artificial Sequence
  Engineered Variant of Kred from Lactobacillus kefir
atgaccgatcgtctgaagcataaagtagccatcgtaaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccgtcgtgaacaatgcagggatgggggttattaaaagcgttgaagacactaccacggaggaatggcgtaaactgctgtccgttaatctggatggtgtttttttcggcacccgtctgggcattcagcgcatgaaaaataaaggcttgggcgctagcatcatcaatatgagcagtattctggggctcgtaggcgatccgacgctgggggcatacaacgcttccaagggggcggtacgtatcatgtcgaaaagcgcagcgctggattgcgcactgaaggactacgatgtgcgtgtcaacacagtacatccgggccccatcaagaccccgcggctcgatgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 46 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTVVNNAGMGVIKSVEDTTTEEWRKLLSVNLDGVFFGTRLGIQRMKNKGLGASIINMSSILGLVGDPTLGAYNASKGAVRIMSKSAALDCALKDYDVRVNTVHPGPIKTPRLDDLEGWEEMMSQRTLTPMGHIGEPNDIAWICVYLASDESKFATGAEFVVDGGWTAQ

SEQ ID NO: 47 - DNA, 756 bp, Artificial Sequence
  Engineered Variant of Kred from Lactobacillus kefir
atgaccgatcgtctgaagcataaagtagccatcgtaaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccgtcgtgaacaatgcagggattggggttattaaaagcgttgaagacactaccacggaggaatggcgtaaactgctgtccgttaatctggatggtgtttttttcggcacccgtctgggcattcagcgcatgaaaaataaaggcttgggcgctagcatcatcaatatgagcagtattctggggctcgtaggcgatccgacgctgggggcatacaacgcttccaagggggcggtacgtatcatgtcgaaaagcgcagcgctggattgcgcactgaaggactacgatgtgcgtgtcaacacagtacatccgggccccatcaagaccccgcggctcggtgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 48 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTVVNNAGIGVIKSVEDTTTEEWRKLLSVNLDGVFFGTRLGIQRMKNKGLGASIINMSSILGLVGDPTLGAYNASKGAVRIMSKSAALDCALKDYDVRVNTVHPGPIKTPRLGDLEGWEEMMSQRTLTPMGHIGEPNDIAWICVYLASDESKFATGAEFVVDGGWTAQ

SEQ ID NO: 49 - DNA, 756 bp, Artificial Sequence
  Engineered Variant of Kred from Lactobacillus kefir
atgaccgatcgtctgaagcataaagtagccatcgtaaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccgtcgtgaacaatgcagggattggggttattaaaagcgttgaagacactaccacggaggaatggcgtaaactgctgtccgttaatctggatggtgtttttttcggcacccgtctgggcattcagcgcatgaaaaataaaggcttgggcgctagcatcatcaatatgagcagtattctggggctcgtaggcgatccgacgctgggggcatacaacgcttccaagggggcggtacgtatcatgtcgaaaagcgcagcgctggattgcgcactgaaggactacgatgtgcgtgtcaacacagtacatccgggccccatcaagaccaatcggctcgatgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 50 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTVVNNAGIGVIKSVEDTTTEEWRKLLSVNLDGVFFGTRLGIQRMKNKGLGASIINMSSILGLVGDPTLGAYNASKGAVRIMSKSAALDCALKDYDVRVNTVHPGPIKTNRLDDLEGWEEMMSQRTLTPMGHIGEPNDIAWICVYLASDESKFATGAEFVVDGGWTAQ

SEQ ID NO: 51 - DNA, 756 bp, Artificial Sequence
  Engineered Variant of Kred from Lactobacillus kefir
atgaccgatcgtctgaagcataaagtagccatcgtaaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccgtcgtgaacaatgcagggattggggttattaaaagcgttgaagacactaccacggaggaatggcgtaaactgctgtccgttaatctggatggtgtttttttcggcacccgtctgggcattcagcgcatgaaaaataaaggcttgggcgctagcatcatcaatatgagcagtattctggggctcgtaggcgatccgacgctgggggcatacaacgcttccaagggggcggtacgtatcatgtcgaaaagcgcagcgctggattgcgcactgaaggactacgatgtgcgtgtcaacacagtacatccgggccccatcaagaccccgcggctcgatgatctgttgggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 52 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTVVNNAGIGVIKSVEDTTTEEWRKLLSVNLDGVFFGTRLGIQRMKNKGLGASIINMSSILGLVGDPTLGAYNASKGAVRIMSKSAALDCALKDYDVRVNTVHPGPIKTPRLDDLLGWEEMMSQRTLTPMGHIGEPNDIAWICVYLASDESKFATGAEFVVDGGWTAQ

SEQ ID NO: 53 - DNA, 756 bp, Artificial Sequence
  Engineered Variant of Kred from Lactobacillus kefir
atgaccgatcgtctgaagcataaagtagccatcgtaaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccgtcgtgaacaatgcagggattggggttattaaaagcgttgaagacactaccacggaggaatggcgtaaaattctgtccgttaatctggatggtgtttttttcggcacccgtctgggcattcagcgcatgaaaaataaaggcttgggcgctagcatcatcaatatgagcagtattctggggctcgtaggcgatccgacgctgggggcatacaacgcttccaagggggcggtacgtatcatgtcgaaaagcgcagcgctggattgcgcactgaaggactacgatgtgcgtgtcaacacagtacatccgggccccatcaagaccccgcggctcgatgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 54 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTVVNNAGIGVIKSVEDTTTEEWRKILSVNLDGVFFGTRLGIQRMKNKGLGASIINMSSILGLVGDPTLGAYNASKGAVRIMSKSAALDCALKDYDVRVNTVHPGPIKTPRLDDLEGWEEMMSQRTLTPMGHIGEPNDIAWICVYLASDESKFATGAEFVVDGGWTAQ

SEQ ID NO: 55 - DNA, 756 bp, Artificial Sequence
  Engineered Variant of Kred from Lactobacillus kefir
atgaccgatcgtctgaagcataaagtagccatcgtaaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccgtcgtgaacaatgcagggattggggttattaaaagcgttgaagacactaccacggaggaatggcgtaaactgctgtccgttaatctggatggtgtttttttcggcacccgtctgggcattcagcgcatgaaaaataaaggcttgggcgctagcatcatcaatatgagcagtattctggggctcgtaggcgatccgacgctgggggcatacaacgcttccaagggggcggtacgtatcatgtcgaaaagcgcagcgctggattgcgcactgaaggactacgatgtgcgtgtcaacacagtacatccgggccccatcaagaccccgcggctcgatgatctggaaggttgggaggaaatgatgtcacagcgtacgttaacccctatgggccacattggcgaaccgaatgacatcgcatggctgtgtgtgtacctggcatctgacgaatcgaaatttgcgacgggtgcagaatttgtggtcgacggcgggtggaccgcacag

SEQ ID NO: 56 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTVVNNAGIGVIKSVEDTTTEEWRKLLSVNLDGVFFGTRLGIQRMKNKGLGASIINMSSILGLVGDPTLGAYNASKGAVRIMSKSAALDCALKDYDVRVNTVHPGPIKTPRLDDLEGWEEMMSQRTLTPMGHIGEPNDIAWLCVYLASDESKFATGAEFVVDGGWTAQ

SEQ ID NO: 57 - DNA, 756 bp, Artificial Sequence
  Engineered Variant of Kred from Lactobacillus kefir
atgaccgatcgtctgaagcataaagtagccatcgtaaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccgtcgtgaacaatgcagggacgggggttattaaaagcgttgaagacactaccacggaggaatggcgtaaactgctgtccgttaatctggatggtgtttttttcggcacccgtctgggcattcagcgcatgaaaaataaaggcttgggcgctagcatcatcaatatgagcagtattctggggctcgtaggcgatccgacgctgggggcatacaacgcttccaagggggcggtacgtatcatgtcgaaaagcgcagcgctggattgcgcactgaaggactacgatgtgcgtgtcaacacagtacatccgggccccatcaagaccccgcggctcgatgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 58 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTVVNNAGTGVIKSVEDTTTEEWRKLLSVNLDGVFFGTRLGIQRMKNKGLGASIINMSSILGLVGDPTLGAYNASKGAVRIMSKSAALDCALKDYDVRVNTVHPGPIKTPRLDDLEGWEEMMSQRTLTPMGHIGEPNDIAWICVYLASDESKFATGAEFVVDGGWTAQ

SEQ ID NO: 59 - DNA, 756 bp, Artificial Sequence
  Engineered Variant of Kred from Lactobacillus kefir
atgaccgatcgtctgaagcataaagtagccatcgtaaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccgtcgtgaacaatgcagggattggggttattaaaagcgttgaagacactaccacggaggaatggcgtaaactgctgtccgttaatctggatggtgtttttttcggcacccgtctgggcattcagcgcatgaaaaataaaggcttgggcgctagcatcatcaatatgagcagtattctggggctcgtaggcgatccgacgctgggggcatacaacgcttccaagggggcggtacgtatcatgtcgaaaagcgcagcgctggattgcgcactgaaggactacgatgtgcgtgtcaacacagtacatccgggccccatcaagaccccgcggctcgatgatctggaaggttgggaggaaatgatgtcacagcgtacgttaagtcctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 60 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTVVNNAGIGVIKSVEDTTTEEWRKLLSVNLDGVFFGTRLGIQRMKNKGLGASIINMSSILGLVGDPTLGAYNASKGAVRIMSKSAALDCALKDYDVRVNTVHPGPIKTPRLDDLEGWEEMMSQRTLSPMGHIGEPNDIAWICVYLASDESKFATGAEFVVDGGWTAQ

SEQ ID NO: 61 - DNA, 756 bp, Artificial Sequence
  Engineered Variant of Kred from Lactobacillus kefir
atgaccgatcgtctgaagcataaagtagccatcgtaaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccgtcgtgaacaatgcagggattggggttattaaaagcgttgaagacactaccacggaggaatggcgtaaactgctgtccgttaatctggatggtgtttttttcggcacccgtctgggcattcagcgcatgaaaaataaaggcttgggcgctagcatcatcaatatgagcagtattctggggctcgtaggcgatccgacgctgggggcatacaacgcttccaagggggcggtacgtatcatgtcgaaaagcgcagcgctggattgcgcactgaaggactacgatgtgcgtgtcaacacagtacatccgggccccatcaagacccatcggctcgatgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 62 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTVVNNAGIGVIKSVEDTTTEEWRKLLSVNLDGVFFGTRLGIQRMKNKGLGASIINMSSILGLVGDPTLGAYNASKGAVRIMSKSAALDCALKDYDVRVNTVHPGPIKTHRLDDLEGWEEMMSQRTLTPMGHIGEPNDIAWICVYLASDESKFATGAEFVVDGGWTAQ

SEQ ID NO: 63 - DNA, 756 bp, Artificial Sequence
  Engineered Variant of Kred from Lactobacillus kefir
atgaccgatcgtctgaagcataaagtagccatcgtaaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccgtcgtgaacaatgcagggattggggttattaaaagcgttgaagacactaccacggaggaatggcgtaaactgctgtccgttaatctggatggtgtttttttcggcacccgtctgggcattcagcgcatgaaaaataaaggcttgggcgctagcatcatcaatatgagcagtattctggggctcgtaggcgatccgtctctgggggcatacaacgcttccaagggggcggtacgtatcatgtcgaaaagcgcagcgctggattgcgcactgaaggactacgatgtgcgtgtcaacacagtacatccgggccccatcaagaccccgcggctcgatgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 64 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTVVNNAGIGVIKSVEDTTTEEWRKLLSVNLDGVFFGTRLGIQRMKNKGLGASIINMSSILGLVGDPSLGAYNASKGAVRIMSKSAALDCALKDYDVRVNTVHPGPIKTPRLDDLEGWEEMMSQRTLTPMGHIGEPNDIAWICVYLASDESKFATGAEFVVDGGWTAQ

SEQ ID NO: 65 - DNA, 756 bp, Artificial Sequence
  Engineered Variant of Kred from Lactobacillus kefir
atgaccgatcgtctgaagcataaagtagccatcattaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccgtcgtgaacaatgcagggattggggttattaaaagcgttgaagacactaccacggaggaatggcgtaaactgctgtccgttaatctggatggtgtttttttcggcacccgtctgggcattcagcgcatgaaaaataaaggcttgggcgctagcatcatcaatatgagcagtattctggggctcgtaggcgatccgacgctgggggcatacaacgcttccaagggggcggtacgtatcatgtcgaaaagcgcagcgctggattgcgcactgaaggactacgatgtgcgtgtcaacacagtacatccgggccccatcaagaccccgcggctcgatgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 66 - protein, 252 aa, Artificial Sequence
  Engineered Variant of Kred from Lactobacillus kefir
MTDRLKHKVAIITGGTLGIGLAIADKFVEEGAKVVITGRHADVGEKAAKSIGGTDVIRFVQHDASEEAGWTKLFDTTEEAFGPVTTVVNNAGIGVIKSVEDTTTEEWRKLLSVNLDGVFFGTRLGIQRMKNKGLGASIINMSSILGLVGDPTLGAYNASKGAVRIMSKSAALDCALKDYDVRVNTVHPGPIKTPRLDDLEGWEEMMSQRTLTPMGHIGEPNDIAWICVYLASDESKFATGAEFVVDGGWTAQ

SEQ ID NO: 67 - DNA, 756 bp, Artificial Sequence
  Engineered Variant of Kred from Lactobacillus kefir
atgaccgatcgtctgaagcataaagtagccatcgtaaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccgtcgtgaacaatgcagggattggggttattgggagcgttgaagacactaccacggaggaatggcgtaaactgctgtccgttaatctggatggtgtttttttcggcacccgtctgggcattcagcgcatgaaaaataaaggcttgggcgctagcatcatcaatatgagcagtattctggggctcgtaggcgatccgacgctgggggcatacaacgcttccaagggggcggtacgtatcatgtcgaaaagcgcagcgctggattgcgcactgaaggactacgatgtgcgtgtcaacacagtacatccgggccccatcaagaccccgcggctcgatgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 68 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTVVNNAGIGVIGSVEDTTTEEWRKLLSVNLDGVFFGTRLGIQRMKNKGLGASIINMSSILGLVGDPTLGAYNASKGAVRIMSKSAALDCALKDYDVRVNTVHPGPIKTPRLDDLEGWEEMMSQRTLTPMGHIGEPNDIAWICVYLASDESKFATGAEFVVDGGWTAQ

SEQ ID NO: 69 - DNA, 756 bp, Artificial Sequence
  Engineered Variant of Kred from Lactobacillus kefir
atgaccgatcgtctgaagcataaagtagccatcgtaaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccttggtgaacaatgcagggattggggttattaaaagcgttgaagacactaccacggaggaatggcgtaaactgctgtccgttaatctggatggtgtttttttcggcacccgtctgggcattcagcgcatgaaaaataaaggcttgggcgctagcatcatcaatatgagcagtattctggggctcgtaggcgatccgacgctgggggcatacaacgcttccaagggggcggtacgtatcatgtcgaaaagcgcagcgctggattgcgcactgaaggactacgatgtgcgtgtcaacacagtacatccgggccccatcaagaccccgcggctcgatgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 70 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTLVNNAGIGVIKSVEDTTTEEWRKLLSVNLDGVFFGTRLGIQRMKNKGLGASIINMSSILGLVGDPTLGAYNASKGAVRIMSKSAALDCALKDYDVRVNTVHPGPIKTPRLDDLEGWEEMMSQRTLTPMGHIGEPNDIAWICVYLASDESKFATGAEFVVDGGWTAQ

SEQ ID NO: 71 - DNA, 756 bp, Artificial Sequence
  Engineered Variant of Kred from Lactobacillus kefir
atgaccgatcgtctgaagcataaagtagccatcattaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccgtcgtgaacaatgcagggattggggttattaaaagcgttgaagacactaccacggaggaatggcgtaaactgctgtccgttaatctggatggtgtttttttcggcacccgtctgggcattcagcgcatgaaaaataaaggcttgggcgctagcatcatcaatatgagcagtattatggggctcgtaggcgatccgactctgggggcatacaacgcttccaagggggcggtacgtatcatgtcgaaaagcgcagcgctggattgcgcactgaaggactacgatgtgcgtgtcaacacagtacatccgggccccatcaagaccccgcggaaggatgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 72 - protein, 252 aa, Artificial Sequence
  Engineered Variant of Kred from Lactobacillus kefir
MTDRLKHKVAIITGGTLGIGLAIADKFVEEGAKVVITGRHADVGEKAAKSIGGTDVIRFVQHDASEEAGWTKLFDTTEEAFGPVTTVVNNAGIGVIKSVEDTTTEEWRKLLSVNLDGVFFGTRLGIQRMKNKGLGASIINMSSIMGLVGDPTLGAYNASKGAVRIMSKSAALDCALKDYDVRVNTVHPGPIKTPRKDDLEGWEEMMSQRTLTPMGHIGEPNDIAWICVYLASDESKFATGAEFVVDGGWTAQ

SEQ ID NO: 73 - DNA, 756 bp, Artificial Sequence
  Engineered Variant of Kred from Lactobacillus kefir
atgaccgatcgtctgaagcataaagtagccatcgtaaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccgtggtgaacaatgcagggattggggttattaaaagcgttgaagacactaccacggaggaatggcgtaaactgctgtccgttaatctggatggtgtttttttcggcacccgtctgggcattcagcgcatgaaaaataaaggcttgggcgctagcatcatcaatatgagcagtattatggggctcgtaggcgatccgacgctgggggcatacaacgcttccaagggggcggtacgtatcatgtcgaaaagcgcagcgctggattgcgcactgaaggactacgatgtgcgtgtcaacacagtacatccgggccccatcaagaccccgcggaaggatgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 74 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTVVNNAGIGVIKSVEDTTTEEWRKLLSVNLDGVFFGTRLGIQRMKNKGLGASIINMSSIMGLVGDPTLGAYNASKGAVRIMSKSAALDCALKDYDVRVNTVHPGPIKTPRKDDLEGWEEMMSQRTLTPMGHIGEPNDIAWICVYLASDESKFATGAEFVVDGGWTAQ

SEQ ID NO: 75 - DNA, 756 bp, Artificial Sequence
  Engineered Variant of Kred from Lactobacillus kefir
atgaccgatcgtctgaagcataaagtagccatcgttaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggttattaaaagcgttgaagacactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgatccgactctgggggcatacaacgcttccaagggggcggtacgtatcatgtcgaaaagcgcagcgctggattgcgcactgaaggactacgatgtgcgtgtcaacacagtacatccgggccccatcaagacccctcggaaagatgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 76 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTLVNNAGIGVIKSVEDTTTEEWRKILSVNLDGVFFGTRLGIQRMKNKGLGASIINMSSIMGLVGDPTLGAYNASKGAVRIMSKSAALDCALKDYDVRVNTVHPGPIKTPRKDDLEGWEEMMSQRTLTPMGHIGEPNDIAWICVYLASDESKFATGAEFVVDGGWTAQ

SEQ ID NO: 77 - DNA, 756 bp, Artificial Sequence
  Engineered Variant of Kred from Lactobacillus kefir
atgaccgatcgtctgaagcataaagtagccatcgttaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccgtcgtgaacaatgcagggattggggttattaaaagcgttgaagacactaccacggaggaatggcgtaaactgctgtccgttaatctggatggtgtttttttcggcacccgtctgggcattcagcgcatgaaaaataaaggcttgggcgctagcatcatcaatatgagcagtattatggggctcgtaggcgatccgggcctgggggcatacaacgcttccaagggggcggtacgtatcatgtcgaaaagcgcagcgctggattgcgcactgaaggactacgatgtgcgtgtcaacacagtacatccgggccccatcaagaccccgcggaaggatgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 78 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTVVNNAGIGVIKSVEDTTTEEWRKLLSVNLDGVFFGTRLGIQRMKNKGLGASIINMSSIMGLVGDPGLGAYNASKGAVRIMSKSAALDCALKDYDVRVNTVHPGPIKTPRKDDLEGWEEMMSQRTLTPMGHIGEPNDIAWICVYLASDESKFATGAEFVVDGGWTAQ

SEQ ID NO: 79 - DNA, 756 bp, Artificial Sequence
  Engineered Variant of Kred from Lactobacillus kefir
atgaccgatcgtctgaagcataaagtagccatcgttaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggttattaaaagcgttgaagacactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgatccgactctgggggcatacaacgcttccaagggggcggtacgtatcatgtcgaaaagcgcagcgctggattgcgcactgaaggactacgatgtgcgtgtcaacacagtacatccgggccccatcaagaccccgcggaaggatgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 80 - protein, 252 aa, Artificial Sequence; identical to SEQ ID NO: 76
  Engineered Variant of Kred from Lactobacillus kefir

SEQ ID NO: 81 - DNA, 756 bp, Artificial Sequence
  Engineered Variant of Kred from Lactobacillus kefir
atgaccgatcgtctgaagcataaagtagccatcattaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccgtggtgaacaatgcagggattggggttattaaaagcgttgaagacactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgatccgggcctgggggcatacaacgcttccaagggggcggtacgtatcatgtcgaaaagcgcagcgctggattgcgcactgaaggactacgatgtgcgtgtcaacacagtacatccgggccccatcaagaccccgcggaaggatgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 82 - protein, 252 aa, Artificial Sequence
  Engineered Variant of Kred from Lactobacillus kefir
MTDRLKHKVAIITGGTLGIGLAIADKFVEEGAKVVITGRHADVGEKAAKSIGGTDVIRFVQHDASEEAGWTKLFDTTEEAFGPVTTVVNNAGIGVIKSVEDTTTEEWRKILSVNLDGVFFGTRLGIQRMKNKGLGASIINMSSIMGLVGDPGLGAYNASKGAVRIMSKSAALDCALKDYDVRVNTVHPGPIKTPRKDDLEGWEEMMSQRTLTPMGHIGEPNDIAWICVYLASDESKFATGAEFVVDGGWTAQ

SEQ ID NO: 83 - DNA, 756 bp, Artificial Sequence
  Engineered Variant of Kred from Lactobacillus kefir
atgaccgatcgtctgaagcataaagtagccatcgttaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccgtggtgaacaatgcagggattggggttattaaaagcgttgaagacactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgatccgactctgggggcatacaacgcttccaagggggcggtacgtatcatgtcgaaaagcgcagcgctggattgcgcactgaaggactacgatgtgcgtgtcaacacagtacatccgggccccatcaagacccatcggaaagatgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 84 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTVVNNAGIGVIKSVEDTTTEEWRKILSVNLDGVFFGTRLGIQRMKNKGLGASIINMSSIMGLVGDPTLGAYNASKGAVRIMSKSAALDCALKDYDVRVNTVHPGPIKTHRKDDLEGWEEMMSQRTLTPMGHIGEPNDIAWICVYLASDESKFATGAEFVVDGGWTAQ

SEQ ID NO: 85 - DNA, 756 bp, Artificial Sequence
  Engineered Variant of Kred from Lactobacillus kefir
atgaccgatcgtctgaagcataaagtagccatcgttaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccgtggtgaacaatgcagggattggggttattaaaagcgttgaagacactaccacggaggaatggcgtaaaatcctgtccgttaatctggatggtgtttttttcggcacccgtctgggcatacagcgcatgaaaaataaaggcttgggcgctagcatcatcaatatgagcagtattatggggctcgtaggcgatccgggcctgggggcatacaacgcttccaagggggcggtacgtatcatgtcgaaaagcgcagcgctggattgcgcactgaaggactacgatgtgcgtgtcaacacagtacatccgggccccatcaagacccctcggaaaggtgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 86 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTVVNNAGIGVIKSVEDTTTEEWRKILSVNLDGVFFGTRLGIQRMKNKGLGASIINMSSIMGLVGDPGLGAYNASKGAVRIMSKSAALDCALKDYDVRVNTVHPGPIKTPRKGDLEGWEEMMSQRTLTPMGHIGEPNDIAWICVYLASDESKFATGAEFVVDGGWTAQ

SEQ ID NO: 87 - DNA, 756 bp, Artificial Sequence
  Engineered Variant of Kred from Lactobacillus kefir
atgaccgatcgtctgaagcataaagtagccatcgtaaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggttattaaaagcgttgaagacactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgatccgactctgggggcatacaacgcttccaagggggcggtacgtatcatgtcgaaaagcgcagcgctggattgcgcactgaaggactacgatgtgcgtgtcaacacagtacatccgggccccatcaagaccaaccggaaagatgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 88 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTLVNNAGIGVIKSVEDTTTEEWRKILSVNLDGVFFGTRLGIQRMKNKGLGASIINMSSIMGLVGDPTLGAYNASKGAVRIMSKSAALDCALKDYDVRVNTVHPGPIKTNRKDDLEGWEEMMSQRTLTPMGHIGEPNDIAWICVYLASDESKFATGAEFVVDGGWTAQ

SEQ ID NO: 89 - DNA, 756 bp, Artificial Sequence
  Engineered Variant of Kred from Lactobacillus kefir
atgaccgatcgtctgaagcataaagtagccatcgttaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggttattaaaagcgttgaagacactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgatccgactctgggggcatacaacgcttccaagggggcggtacgtatcatgtcgaaaagcgcagcgctggattgcgcactgaaggactacgatgtgcgtgtcaacacagtacatccgggccccatcaagacccatcggaaagatgatctggaaggttgggaggaaatgatgtcacagcgtacgttaacgcctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 90 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTLVNNAGIGVIKSVEDTTTEEWRKILSVNLDGVFFGTRLGIQRMKNKGLGASIINMSSIMGLVGDPTLGAYNASKGAVRIMSKSAALDCALKDYDVRVNTVHPGPIKTHRKDDLEGWEEMMSQRTLTPMGHIGEPNDIAWICVYLASDESKFATGAEFVVDGGWTAQ

SEQ ID NO: 91 - DNA, 756 bp, Artificial Sequence
  Engineered Variant of Kred from Lactobacillus kefir
atgaccgatcgtctgaagcataaagtagccatcgtaaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccgtcgtgaacaatgcagggattggggttattaaaagcgttgaagacactaccacggaggaatggcgtaaactgctgtccgttaatctggatggtgtttttttcggcacccgtctgggcattcagcgcatgaaaaataaaggcttgggcgctagcatcatcaatatgagcagtattctggggctcgtaggcgatccgagcctgggggcatacaacgcttccaagggggcggtacgtatcatgtcgaaaagcgcagcgctggattgcgcactgaaggactacgatgtgcgtgtcaacacagtacatccgggccccatcaagaccccgcggaaggatgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 92 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTVVNNAGIGVIKSVEDTTTEEWRKLLSVNLDGVFFGTRLGIQRMKNKGLGASIINMSSILGLVGDPSLGAYNASKGAVRIMSKSAALDCALKDYDVRVNTVHPGPIKTPRKDDLEGWEEMMSQRTLTPMGHIGEPNDIAWICVYLASDESKFATGAEFVVDGGWTAQ

SEQ ID NO: 93 - DNA, 756 bp, Artificial Sequence
  Engineered Variant of Kred from Lactobacillus kefir
atgaccgatcgtctgaagcataaagtagccatcgttaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccgtggtgaacaatgcagggattggggttattaaaagcgttgaagacactaccacggaggaatggcgtaaactgctgtccgttaatctggatggtgtttttttcggcacccgtctgggcattcagcgcatgaaaaataaaggcttgggcgctagcatcatcaatatgagcagtattatggggctcgtaggcgatccgactctgggggcatacaacgcttccaagggggcggtacgtatcatgtcgaaaagcgcagcgctggattgcgcactgaaggactacgatgtgcgtgtcaacacagtacatccgggccccatcaagacccctcggaaaggtgatctggaaggttgggaggaaatgatgtcacagcgtacgttaacccctatgggccacattggcgaaccgaatgacatcgcatggctgtgtgtgtacctggcatctgacgaatcgaaatttgcgacgggtgcagaatttgtggtcgacggcgggtggaccgcacag

SEQ ID NO: 94 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTVVNNAGIGVIKSVEDTTTEEWRKLLSVNLDGVFFGTRLGIQRMKNKGLGASIINMSSIMGLVGDPTLGAYNASKGAVRIMSKSAALDCALKDYDVRVNTVHPGPIKTPRKGDLEGWEEMMSQRTLTPMGHIGEPNDIAWLCVYLASDESKFATGAEFVVDGGWTAQ

SEQ ID NO: 95 - DNA, 756 bp, Artificial Sequence
  Engineered Variant of Kred from Lactobacillus kefir
atgaccgatcgtctgaagcataaagtagccatcgttaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggttattaaaagcgttgaagacactaccacggaggaatggcgtaaactgctgtccgttaatctggatggtgtttttttcggcacccgtctgggcattcagcgcatgaaaaataaaggcttgggcgctagcatcatcaatatgagcagtattatggggctcgtaggcgatccgactctgggggcatacaacgcttccaagggggcggtacgtatcatgtcgaaaagcgcagcgctggattgcgcactgaaggactacgatgtgcgtgtcaacacagtacatccgggccccatcaagacccatcggaaagatgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 96 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTLVNNAGIGVIKSVEDTTTEEWRKLLSVNLDGVFFGTRLGIQRMKNKGLGASIINMSSIMGLVGDPTLGAYNASKGAVRIMSKSAALDCALKDYDVRVNTVHPGPIKTHRKDDLEGWEEMMSQRTLTPMGHIGEPNDIAWICVYLASDESKFATGAEFVVDGGWTAQ

SEQ ID NO: 97 - DNA, 756 bp, Artificial Sequence
  Engineered Variant of Kred from Lactobacillus kefir
atgaccgatcgtctgaagcataaagtagccatcgttaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccgtggtgaacaatgcagggattggggttattaaaagcgttgaagacactaccacggaggaatggcgtaaaatcctgtccgttaatctggatggtgtttttttcggcacccgtctgggcattcagcgcatgaaaaataaaggcttgggcgctagcatcatcaatatgagcagtattctggggctcgtaggcgatccgactctgggggcatacaacgcttccaagggggcggtacgtatcatgtcgaaaagcgcagcgctggattgcgcactgaaggactacgatgtgcgtgtcaacacagtacatccgggccccatcaagacccctcggaaagatgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 98 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTVVNNAGIGVIKSVEDTTTEEWRKILSVNLDGVFFGTRLGIQRMKNKGLGASIINMSSILGLVGDPTLGAYNASKGAVRIMSKSAALDCALKDYDVRVNTVHPGPIKTPRKDDLEGWEEMMSQRTLTPMGHIGEPNDIAWICVYLASDESKFATGAEFVVDGGWTAQ

SEQ ID NO: 99 - DNA, 756 bp, Artificial Sequence
  Engineered Variant of Kred from Lactobacillus kefir
atgaccgatcgtctgaagcataaagtagccatcgttaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggttattaaaagcgttgaagacactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgatccgactctgggggcatacaacgcttccaagggggcggtacgtatcatgtcgaaaagcgcagcgctggattgcgcactgaaggactacgatgtgcgtgtcaacacagtacatccgggccccatcaagaccccgcggaaggatgatctggaaggttgggaggaaatgatgtcacagcgtacgcgtacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 100 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTLVNNAGIGVIKSVEDTTTEEWRKILSVNLDGVFFGTRLGIQRMKNKGLGASIINMSSIMGLVGDPTLGAYNASKGAVRIMSKSAALDCALKDYDVRVNTVHPGPIKTPRKDDLEGWEEMMSQRTRTPMGHIGEPNDIAWICVYLASDESKFATGAEFVVDGGWTAQ

SEQ ID NO: 101 - DNA, 756 bp, Artificial Sequence
  Engineered Variant of Kred from Lactobacillus kefir
atgaccgatcgtctgaagcataaagtagccatcgttaccggcgggacaagtggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggttattaaaagcgttgaagacactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgatccgactctgggggcatacaacgcttccaagggggcggtacgtatcatgtcgaaaagcgcagcgctggattgcgcactgaaggactacgatgtgcgtgtcaacacagtacatccgggccccatcaagaccccgcggaaggatgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 102 - protein, 252 aa, Artificial Sequence
  Engineered Variant of Kred from Lactobacillus kefir
MTDRLKHKVAIVTGGTSGIGLAIADKFVEEGAKVVITGRHADVGEKAAKSIGGTDVIRFVQHDASEEAGWTKLFDTTEEAFGPVTTLVNNAGIGVIKSVEDTTTEEWRKILSVNLDGVFFGTRLGIQRMKNKGLGASIINMSSIMGLVGDPTLGAYNASKGAVRIMSKSAALDCALKDYDVRVNTVHPGPIKTPRKDDLEGWEEMMSQRTLTPMGHIGEPNDIAWICVYLASDESKFATGAEFVVDGGWTAQ

SEQ ID NO: 103 - DNA, 756 bp, Artificial Sequence
  Engineered Variant of Kred from Lactobacillus kefir
atgaccgatcgtctgaagcataaagtagccatcgttaccggcgggacacagggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggttattaaaagcgttgaagacactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgatccgactctgggggcatacaacgcttccaagggggcggtacgtatcatgtcgaaaagcgcagcgctggattgcgcactgaaggactacgatgtgcgtgtcaacacagtacatccgggccccatcaagaccccgcggaaggatgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 104 - protein, 252 aa, Artificial Sequence
  Engineered Variant of Kred from Lactobacillus kefir
MTDRLKHKVAIVTGGTQGIGLAIADKFVEEGAKVVITGRHADVGEKAAKSIGGTDVIRFVQHDASEEAGWTKLFDTTEEAFGPVTTLVNNAGIGVIKSVEDTTTEEWRKILSVNLDGVFFGTRLGIQRMKNKGLGASIINMSSIMGLVGDPTLGAYNASKGAVRIMSKSAALDCALKDYDVRVNTVHPGPIKTPRKDDLEGWEEMMSQRTLTPMGHIGEPNDIAWICVYLASDESKFATGAEFVVDGGWTAQ

SEQ ID NO: 105 - DNA, 756 bp, Artificial Sequence
  Engineered Variant of Kred from Lactobacillus kefir
atgaccgatcgtctgaagcataaagtagccatcgttaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggttattaaaagcgttgaagacactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgatccgactctgggggcatacaacgcttccaagggggcggtacgtatcatgtcgaaaagcgcagcgctggattgcgcactgaaggactacgatgtgcgtgtcaacacagtacatccgggccccatcaagaccccgcggaaggatgctctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 106 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTLVNNAGIGVIKSVEDTTTEEWRKILSVNLDGVFFGTRLGIQRMKNKGLGASIINMSSIMGLVGDPTLGAYNASKGAVRIMSKSAALDCALKDYDVRVNTVHPGPIKTPRKDALEGWEEMMSQRTLTPMGHIGEPNDIAWICVYLASDESKFATGAEFVVDGGWTAQ

SEQ ID NO: 107 - DNA, 756 bp, Artificial Sequence
  Engineered Variant of Kred from Lactobacillus kefir
atgaccgatcgtctgaagcataaagtagccatcgttaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggttattaaaagcgttgaagacactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgatccgaagctgggggcatacaacgcttccaagggggcggtacgtatcatgtcgaaaagcgcagcgctggattgcgcactgaaggactacgatgtgcgtgtcaacacagtacatccgggccccatcaagaccccgcggaaggatgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 108 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTLVNNAGIGVIKSVEDTTTEEWRKILSVNLDGVFFGTRLGIQRMKNKGLGASIINMSSIMGLVGDPKLGAYNASKGAVRIMSKSAALDCALKDYDVRVNTVHPGPIKTPRKDDLEGWEEMMSQRTLTPMGHIGEPNDIAWICVYLASDESKFATGAEFVVDGGWTAQ

SEQ ID NO: 109 - DNA, 756 bp, Artificial Sequence
  Engineered Variant of Kred from Lactobacillus kefir
atgaccgatcgtctgaagcataaagtagccatcgttaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggttattaaaagcgttgaaacgactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgatccgactctgggggcatacaacgcttccaagggggcggtacgtatcatgtcgaaaagcgcagcgctggattgcgcactgaaggactacgatgtgcgtgtcaacacagtacatccgggccccatcaagaccccgcggaaggatgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 110 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTLVNNAGIGVIKSVETTTTEEWRKILSVNLDGVFFGTRLGIQRMKNKGLGASIINMSSIMGLVGDPTLGAYNASKGAVRIMSKSAALDCALKDYDVRVNTVHPGPIKTPRKDDLEGWEEMMSQRTLTPMGHIGEPNDIAWICVYLASDESKFATGAEFVVDGGWTAQ

SEQ ID NO: 111 - DNA, 756 bp, Artificial Sequence
  Engineered Variant of Kred from Lactobacillus kefir
atgaccgatcgtctgaagcataaagtagccatcgttaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggttattaaaagcgttgaagacactaccacggaggaatggcgtaaagtgctgtccgttaatctggatggtgtttttttcggcacccgtctgggcattcagcgcatgaaaaataaaggcttgggcgctagcatcatcaatatgagcagtattatggggctcgtaggcgatccgactctgggggcatacaacgcttccaagggggcggtacgtatcatgtcgaaaagcgcagcgctggattgcgcactgaaggactacgatgtgcgtgtcaacacagtacatccgggccccatcaagaccccgcggaaggatgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 112 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTLVNNAGIGVIKSVEDTTTEEWRKVLSVNLDGVFFGTRLGIQRMKNKGLGASIINMSSIMGLVGDPTLGAYNASKGAVRIMSKSAALDCALKDYDVRVNTVHPGPIKTPRKDDLEGWEEMMSQRTLTPMGHIGEPNDIAWICVYLASDESKFATGAEFVVDGGWTAQ

SEQ ID NO: 113 - DNA, 756 bp, Artificial Sequence
  Engineered Variant of Kred from Lactobacillus kefir
atgaccgatcgtctgaagcataaagtagccatcgttaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggttattaaaagcgttgaatgtactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgatccgactctgggggcatacaacgcttccaagggggcggtacgtatcatgtcgaaaagcgcagcgctggattgcgcactgaaggactacgatgtgcgtgtcaacacagtacatccgggccccatcaagaccccgcggaaggatgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 114 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTLVNNAGIGVIKSVECTTTEEWRKILSVNLDGVFFGTRLGIQRMKNKGLGASIINMSSIMGLVGDPTLGAYNASKGAVRIMSKSAALDCALKDYDVRVNTVHPGPIKTPRKDDLEGWEEMMSQRTLTPMGHIGEPNDIAWICVYLASDESKFATGAEFVVDGGWTAQ

SEQ ID NO: 115 - DNA, 756 bp, Artificial Sequence
  Engineered Variant of Kred from Lactobacillus kefir
atgaccgatcgtctgaagcataaagtagccatcgttaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggttattaaaagcgttgaagacactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgatccgactctgggggcatacaacgcttccaagggggcggtacgtatcatgtcgaaaagcgcagcgctggattgcgcactgaaggactacgatgtgcgtgtcaacacagtacatccgggcgcgatcaagaccccgcggaaggatgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 116 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTLVNNAGIGVIKSVEDTTTEEWRKILSVNLDGVFFGTRLGIQRMKNKGLGASIINMSSIMGLVGDPTLGAYNASKGAVRIMSKSAALDCALKDYDVRVNTVHPGAIKTPRKDDLEGWEEMMSQRTLTPMGHIGEPNDIAWICVYLASDESKFATGAEFVVDGGWTAQ

SEQ ID NO: 117 - DNA, 756 bp, Artificial Sequence
  Engineered Variant of Kred from Lactobacillus kefir
atgaccgatcgtctgaagcataaagtagccatcgttaccggcgggacactgggtatcggtttggcaatcgccgataaatttgtagaggagggtgcgaaagtagttattactggtcgtcacgcggatgtaggtgaaaaggccgccaaatcaatcggcggcactgattgtattcgctttgtccagcacgatgcgtccgaagaagcaggctggacgaaactgttcgacaccaccgaggaggcattcggcccggttacgaccctggtgaacaatgcagggattggggttattaaaagcgttgaagacactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgatccgactctgggggcatacaacgcttccaagggggcggtacgtatcatgtcgaaaagcgcagcgctggattgcgcactgaaggactacgatgtgcgtgtcaacacagtacatccgggccccatcaagaccccgcggaaggatgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 118 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDCIRFVQHDASEEAGWTKLFDTTEEAFGPVTTLVNNAGIGVIKSVEDTTTEEWRKILSVNLDGVFFGTRLGIQRMKNKGLGASIINMSSIMGLVGDPTLGAYNASKGAVRIMSKSAALDCALKDYDVRVNTVHPGPIKTPRKDDLEGWEEMMSQRTLTPMGHIGEPNDIAWICVYLASDESKFATGAEFVVDGGWTAQ

SEQ ID NO: 119 - DNA, 756 bp, Artificial Sequence
  Engineered Variant of Kred from Lactobacillus kefir
atgaccgatcgtctgaagcataaagtagccatcgttaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggttattaaaagcgttgaagacactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgatccgactctgggggcatacaacgcttccaaggggggtgtacgtatcatgtcgaaaagcgcagcgctggattgcgcactgaaggactacgatgtgcgtgtcaacacagtacatccgggccccatcaagaccccgcggaaggatgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 120 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTLVNNAGIGVIKSVEDTTTEEWRKILSVNLDGVFFGTRLGIQRMKNKGLGASIINMSSIMGLVGDPTLGAYNASKGGVRIMSKSAALDCALKDYDVRVNTVHPGPIKTPRKDDLEGWEEMMSQRTLTPMGHIGEPNDIAWICVYLASDESKFATGAEFVVDGGWTAQ

SEQ ID NO: 121 - DNA, 756 bp, Artificial Sequence
  Engineered Variant of Kred from Lactobacillus kefir
atgaccgatcgtctgaagcataaagtagccatcgttaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattgggattattaaaagcgttgaagacactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgatccgactctgggggcatacaacgcttccaagggggcggtacgtatcatgtcgaaaagcgcagcgctggattgcgcactgaaggactacgatgtgcgtgtcaacacagtacatccgggccccatcaagaccccgcggaaggatgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 122 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTLVNNAGIGIIKSVEDTTTEEWRKILSVNLDGVFFGTRLGIQRMKNKGLGASIINMSSIMGLVGDPTLGAYNASKGAVRIMSKSAALDCALKDYDVRVNTVHPGPIKTPRKDDLEGWEEMMSQRTLTPMGHIGEPNDIAWICVYLASDESKFATGAEFVVDGGWTAQ

SEQ ID NO: 123 - DNA, 756 bp, Artificial Sequence
  Engineered Variant of Kred from Lactobacillus kefir
atgaccgatcgtctgaagcataaagtagccatcgttaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggttattaaaagcgttgaagacactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgatccgactctgggggcatacaacgcttccaagggggcggtacgtatcatgtcgaaaagcgcagcgctggattgcgcactgaaggactacgatgtgcgtgtcaacacagtacatccgggccccatcaagaccccgcggaaggatgatctggaaggttgggaggaaatgatgtcacagcgttggttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 124 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTLVNNAGIGVIKSVEDTTTEEWRKILSVNLDGVFFGTRLGIQRMKNKGLGASIINMSSIMGLVGDPTLGAYNASKGAVRIMSKSAALDCALKDYDVRVNTVHPGPIKTPRKDDLEGWEEMMSQRWLTPMGHIGEPNDIAWICVYLASDESKFATGAEFVVDGGWTAQ

SEQ ID NO: 125 - DNA, 756 bp, Artificial Sequence
  Engineered Variant of Kred from Lactobacillus kefir
atgaccgatcgtctgaagcataaagtagccatcgttaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggttattaaaagcgttgaagacactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgatccgactctgggggcatacaacgcttccaagggggcggtacgtatcatgtcgaaaagcgcagcgctggattgcgcactgaaggactacgatgtgcgtgtcaacacagtacatccgggccccatcaagaccccgcggaaggatgatctggaaggttgggaggaaatgatgtcacagcgttttttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 126 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTLVNNAGIGVIKSVEDTTTEEWRKILSVNLDGVFFGTRLGIQRMKNKGLGASIINMSSIMGLVGDPTLGAYNASKGAVRIMSKSAALDCALKDYDVRVNTVHPGPIKTPRKDDLEGWEEMMSQRFLTPMGHIGEPNDIAWICVYLASDESKFATGAEFVVDGGWTAQ

SEQ ID NO: 127 - DNA, 756 bp, Artificial Sequence
  Engineered Variant of Kred from Lactobacillus kefir
atgaccgatcgtctgaagcataaagtagccatcgttaccggcgggacactgggtatcggtgctgcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggttattaaaagcgttgaagacactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgatccgactctgggggcatacaacgcttccaagggggcggtacgtatcatgtcgaaaagcgcagcgctggattgcgcactgaaggactacgatgtgcgtgtcaacacagtacatccgggccccatcaagaccccgcggaaggatgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 128 - protein, 252 aa, Artificial Sequence
  Engineered Variant of Kred from Lactobacillus kefir
MTDRLKHKVAIVTGGTLGIGAAIADKFVEEGAKVVITGRHADVGEKAAKSIGGTDVIRFVQHDASEEAGWTKLFDTTEEAFGPVTTLVNNAGIGVIKSVEDTTTEEWRKILSVNLDGVFFGTRLGIQRMKNKGLGASIINMSSIMGLVGDPTLGAYNASKGAVRIMSKSAALDCALKDYDVRVNTVHPGPIKTPRKDDLEGWEEMMSQRTLTPMGHIGEPNDIAWICVYLASDESKFATGAEFVVDGGWTAQ

SEQ ID NO: 129 - DNA, 756 bp, Artificial Sequence
  Engineered Variant of Kred from Lactobacillus kefir
atgaccgatcgtctgaagcataaagtagccatcgttaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggttattaaaagcgttgaagacactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgatccgactctgggggcatacaacgcttccaagggggcggtacgtatcatgtcgaaaagcgcagcgctggattgcgcactgaaggactacgatgtgcgtgtcaacacagtacatccgggccccatcaagaccccgcggaaggatgatctggaaggttgggaggaaatgatgtcacagcgtacgttaacccctatgggccacattggcgaaccgaatgacatcgcatggatcgttgtgtacctggcatctgacgaatcgaaatttgcgacgggtgcagaatttgtggtcgacggcgggtggaccgcacag

SEQ ID NO: 130 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTLVNNAGIGVIKSVEDTTTEEWRKILSVNLDGVFFGTRLGIQRMKNKGLGASIINMSSIMGLVGDPTLGAYNASKGAVRIMSKSAALDCALKDYDVRVNTVHPGPIKTPRKDDLEGWEEMMSQRTLTPMGHIGEPNDIAWIVVYLASDESKFATGAEFVVDGGWTAQ

SEQ ID NO: 131 - DNA, 756 bp, Artificial Sequence
  Engineered Variant of Kred from Lactobacillus kefir
atgaccgatcgtctgaagcataaagtagccatcgttaccggcgggacactgggtatcggtttggcaatcgccgataaatttgtagaggagggtgcgaaagtagttattactggtcgtcacgcggatgtaggtgaagtggccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggttattaaaagcgttgaagacactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgatccgactctgggggcatacaacgcttccaagggggcggtacgtatcatgtcgaaaagcgcagcgctggattgcgcactgaaggactacgatgtgcgtgtcaacacagtacatccgggccccatcaagaccccgcggaaggatgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 132 - protein, 252 aa, Artificial Sequence
  Engineered Variant of Kred from Lactobacillus kefir
MTDRLKHKVAIVTGGTLGIGLAIADKFVEEGAKVVITGRHADVGEVAAKSIGGTDVIRFVQHDASEEAGWTKLFDTTEEAFGPVTTLVNNAGIGVIKSVEDTTTEEWRKILSVNLDGVFFGTRLGIQRMKNKGLGASIINMSSIMGLVGDPTLGAYNASKGAVRIMSKSAALDCALKDYDVRVNTVHPGPIKTPRKDDLEGWEEMMSQRTLTPMGHIGEPNDIAWICVYLASDESKFATGAEFVVDGGWTAQ

SEQ ID NO: 133 - DNA, 756 bp, Artificial Sequence
  Engineered Variant of Kred from Lactobacillus kefir
atgaccgatcgtctgaagcataaagtagccatcgttaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggttattaaaagcgttgaactgactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgatccgactctgggggcatacaacgcttccaagggggcggtacgtatcatgtcgaaaagcgcagcgctggattgcgcactgaaggactacgatgtgcgtgtcaacacagtacatccgggccccatcaagaccccgcggaaggatgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 134 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTLVNNAGIGVIKSVELTTTEEWRKILSVNLDGVFFGTRLGIQRMKNKGLGASIINMSSIMGLVGDPTLGAYNASKGAVRIMSKSAALDCALKDYDVRVNTVHPGPIKTPRKDDLEGWEEMMSQRTLTPMGHIGEPNDIAWICVYLASDESKFATGAEFVVDGGWTAQ

SEQ ID NO: 135 - DNA, 756 bp, Artificial Sequence
  Engineered Variant of Kred from Lactobacillus kefir
atgaccgatcgtctgaagcataaagtagccatcgttaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggttattaaaagcgttgaagacactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgatccgactctgggggcatacaacgcttccaagggggcggtacgtatcatgtcgaaaagcgcagcgctggattgcgcactgaaggactacgatgtgcgtgtcaacacagtacatccgggccccatcaagaccccgcggaaggatcagctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 136 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTLVNNAGIGVIKSVEDTTTEEWRKILSVNLDGVFFGTRLGIQRMKNKGLGASIINMSSIMGLVGDPTLGAYNASKGAVRIMSKSAALDCALKDYDVRVNTVHPGPIKTPRKDQLEGWEEMMSQRTLTPMGHIGEPNDIAWICVYLASDESKFATGAEFVVDGGWTAQ

SEQ ID NO: 137 - DNA, 756 bp, Artificial Sequence
  Engineered Variant of Kred from Lactobacillus kefir
atgaccgatcgtctgaagcataaagtagccatcgttaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggttattaaaagcgttgaagacactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgatccgttgctgggggcatacaacgcttccaagggggcggtacgtatcatgtcgaaaagcgcagcgctggattgcgcactgaaggactacgatgtgcgtgtcaacacagtacatccgggccccatcaagaccccgcggaaggatgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 138 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTLVNNAGIGVIKSVEDTTTEEWRKILSVNLDGVFFGTRLGIQRMKNKGLGASIINMSSIMGLVGDPLLGAYNASKGAVRIMSKSAALDCALKDYDVRVNTVHPGPIKTPRKDDLEGWEEMMSQRTLTPMGHIGEPNDIAWICVYLASDESKFATGAEFVVDGGWTAQ

SEQ ID NO: 139 - DNA, 756 bp, Artificial Sequence
  Engineered Variant of Kred from Lactobacillus kefir
atgaccgatcgtctgaagcataaagtagccatcgttaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgagttggcattcggcccggttacgaccctggtgaacaatgcagggattggggttattaaaagcgttgaagacactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgatccgactctgggggcatacaacgcttccaagggggcggtacgtatcatgtcgaaaagcgcagcgctggattgcgcactgaaggactacgatgtgcgtgtcaacacagtacatccgggccccatcaagaccccgcggaaggatgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 140 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTELAFGPVTTLVNNAGIGVIKSVEDTTTEEWRKILSVNLDGVFFGTRLGIQRMKNKGLGASIINMSSIMGLVGDPTLGAYNASKGAVRIMSKSAALDCALKDYDVRVNTVHPGPIKTPRKDDLEGWEEMMSQRTLTPMGHIGEPNDIAWICVYLASDESKFATGAEFVVDGGWTAQ

SEQ ID NO: 141 - DNA, 756 bp, Artificial Sequence
  Engineered Variant of Kred from Lactobacillus kefir
atgaccgatcgtctgaagcataaagtagccatcgttaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacggcgctgttcgacaccaccgaggaggcattcggcccggttacgaccctggtgaacaatgcagggattggggttattaaaagcgttgaagacactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgatccgactctgggggcatacaacgcttccaagggggcggtacgtatcatgtcgaaaagcgcagcgctggattgcgcactgaaggactacgatgtgcgtgtcaacacagtacatccgggccccatcaagaccccgcggaaggatgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 142 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTALFDTTEEAFGPVTTLVNNAGIGVIKSVEDTTTEEWRKILSVNLDGVFFGTRLGIQRMKNKGLGASIINMSSIMGLVGDPTLGAYNASKGAVRIMSKSAALDCALKDYDVRVNTVHPGPIKTPRKDDLEGWEEMMSQRTLTPMGHIGEPNDIAWICVYLASDESKFATGAEFVVDGGWTAQ

SEQ ID NO: 143 - DNA, 756 bp, Artificial Sequence
  Engineered Variant of Kred from Lactobacillus kefir
atgaccgatcgtctgaagcataaagtagccatcgttaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggttattaaaagcgttgaagacactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgatccgactctgggggcatacaacgcttccaagggggcggtacgtatcatgtcgaaaagcgcagcgctggattgcgcactgaaggactacgatgtgcgtgtcaacacagtacatccgggcgctatcaagaccgagcgcaaggatgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 144 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTLVNNAGIGVIKSVEDTTTEEWRKILSVNLDGVFFGTRLGIQRMKNKGLGASIINMSSIMGLVGDPTLGAYNASKGAVRIMSKSAALDCALKDYDVRVNTVHPGAIKTERKDDLEGWEEMMSQRTLTPMGHIGEPNDIAWICVYLASDESKFATGAEFVVDGGWTAQ

SEQ ID NO: 145 - DNA, 756 bp, Artificial Sequence
  Engineered Variant of Kred from Lactobacillus kefir
atgaccgatcgtctgaagcataaagtagccatcgttaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggttattaaaagcgttgaagacactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgatccgactctgggggcatacaacgcttccaagggggcggtacgtatcatgtcgaaaagcgcagcgctggattgcgcactgaaggactacgatgtgcgtgtcaacacagtacatccgggccctatcaagaccgagcgcaaggatgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 146 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTLVNNAGIGVIKSVEDTTTEEWRKILSVNLDGVFFGTRLGIQRMKNKGLGASIINMSSIMGLVGDPTLGAYNASKGAVRIMSKSAALDCALKDYDVRVNTVHPGPIKTERKDDLEGWEEMMSQRTLTPMGHIGEPNDIAWICVYLASDESKFATGAEFVVDGGWTAQ

SEQ ID NO: 147 - DNA, 756 bp, Artificial Sequence
  Engineered Variant of Kred from Lactobacillus kefir
atgaccgatcgtctgaagcataaagtagccatcgttaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggttattaaaagcgttgaagacactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgatccgactctgggggcatactgcgcttccaagggggcggtacgtatcatgtcgaaaagcgcagcgctggattgcgcactgaaggactacgatgtgcgtgtcaacacagtacatccgggccccatcaagaccccgcggaaggatgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 148 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTLVNNAGIGVIKSVEDTTTEEWRKILSVNLDGVFFGTRLGIQRMKNKGLGASIINMSSIMGLVGDPTLGAYCASKGAVRIMSKSAALDCALKDYDVRVNTVHPGPIKTPRKDDLEGWEEMMSQRTLTPMGHIGEPNDIAWICVYLASDESKFATGAEFVVDGGWTAQ

SEQ ID NO: 149 - DNA, 756 bp, Artificial Sequence
  Engineered Variant of Kred from Lactobacillus kefir
atgaccgatcgtctgaagcataaagtagccatcgttaccggcgggacaatgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggttattaaaagcgttgaagacactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgatccgactctgggggcatacaacgcttccaagggggcggtacgtatcatgtcgaaaagcgcagcgctggattgcgcactgaaggactacgatgtgcgtgtcaacacagtacatccgggccccatcaagaccccgcggaaggatgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 150 - protein, 252 aa, Artificial Sequence
  Engineered Variant of Kred from Lactobacillus kefir
MTDRLKHKVAIVTGGTMGIGLAIADKFVEEGAKVVITGRHADVGEKAAKSIGGTDVIRFVQHDASEEAGWTKLFDTTEEAFGPVTTLVNNAGIGVIKSVEDTTTEEWRKILSVNLDGVFFGTRLGIQRMKNKGLGASIINMSSIMGLVGDPTLGAYNASKGAVRIMSKSAALDCALKDYDVRVNTVHPGPIKTPRKDDLEGWEEMMSQRTLTPMGHIGEPNDIAWICVYLASDESKFATGAEFVVDGGWTAQ

SEQ ID NO: 151 - DNA, 756 bp, Artificial Sequence; identical to SEQ ID NO: 101
  Engineered Variant of Kred from Lactobacillus kefir

SEQ ID NO: 152 - protein, 252 aa, Artificial Sequence; identical to SEQ ID NO: 102
  Engineered Variant of Kred from Lactobacillus kefir

SEQ ID NO: 153 - DNA, 756 bp, Artificial Sequence
  Engineered Variant of Kred from Lactobacillus kefir
atgaccgatcgtctgaagcataaagtagccatcgttaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggttattaaaagcgttgaagacactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgatccgactctgggggcatacaacgcttccaagggggcggtacgtatcatgtcgaaaagcgcagcgctggattgcgcactgaaggactacgatgtgcgtgtcaacacagtacatccgggccctaccaagaccgagcgcaaggatgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 154 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTLVNNAGIGVIKSVEDTTTEEWRKILSVNLDGVFFGTRLGIQRMKNKGLGASIINMSSIMGLVGDPTLGAYNASKGAVRIMSKSAALDCALKDYDVRVNTVHPGPTKTERKDDLEGWEEMMSQRTLTPMGHIGEPNDIAWICVYLASDESKFATGAEFVVDGGWTAQ

SEQ ID NO: 155 - DNA, 756 bp, Artificial Sequence
  Engineered Variant of Kred from Lactobacillus kefir
atgaccgatcgtctgaagcataaagtagccatcgttaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggttattaaaagcgttgaagacactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgatccgactctgggggcatacaacgcttccaagggggcggtacgtatcatgtcgaaaagcgcagcgctggattgcgcactgaaggactacgatgtgcgtgtcaacacagtacatccgggcgctaccaagaccgagcgcaaggatgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 156 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTLVNNAGIGVIKSVEDTTTEEWRKILSVNLDGVFFGTRLGIQRMKNKGLGASIINMSSIMGLVGDPTLGAYNASKGAVRIMSKSAALDCALKDYDVRVNTVHPGATKTERKDDLEGWEEMMSQRTLTPMGHIGEPNDIAWICVYLASDESKFATGAEFVVDGGWTAQ

SEQ ID NO: 157 - DNA, 756 bp, Artificial Sequence
  Engineered Variant of Kred from Lactobacillus kefir
atgaccgatcgtctgaagcataaagtagccatcgttaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggttattaaaagcgttgaagacactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgatccgactctgggggcatacaacgctactaagggggcggtacgtatcatgtcgaaaagcgcagcgctggattgcgcactgaaggactacgatgtgcgtgtcaacacagtacatccgggccccatcaagaccccgcggaaggatgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 158 - protein, 252 aa, Artificial Sequence
  Engineered Variant of Kred from Lactobacillus kefir
MTDRLKHKVAIVTGGTLGIGLAIADKFVEEGAKVVITGRHADVGEKAAKSIGGTDVIRFVQHDASEEAGWTKLFDTTEEAFGPVTTLVNNAGIGVIKSVEDTTTEEWRKILSVNLDGVFFGTRLGIQRMKNKGLGASIINMSSIMGLVGDPTLGAYNATKGAVRIMSKSAALDCALKDYDVRVNTVHPGPIKTPRKDDLEGWEEMMSQRTLTPMGHIGEPNDIAWICVYLASDESKFATGAEFVVDGGWTAQ

SEQ ID NO: 159 - DNA, 756 bp, Artificial Sequence; identical to SEQ ID NO: 135
  Engineered Variant of Kred from Lactobacillus kefir

SEQ ID NO: 160 - protein, 252 aa, Artificial Sequence; identical to SEQ ID NO: 136
  Engineered Variant of Kred from Lactobacillus kefir

SEQ ID NO: 161 - DNA, 756 bp, Artificial Sequence
  Engineered Variant of Kred from Lactobacillus kefir
atgaccgatcgtctgaagcataaagtagccatcgttaccggcgggacactgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggttattaaaagcgttgaagacactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgatccgactctgggggcatacaacgcttccaagggggcggtacgtatcatgtcgaaaagcgcagcgctggattgcgcactgaaggactacgatgtgcgtgtcaacacagtacatccgggccccatcaagaccccgcggaaggatgcgctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 162 - protein, 252 aa, Artificial Sequence; identical to SEQ ID NO: 106
  Engineered Variant of Kred from Lactobacillus kefir

SEQ ID NO: 163 - DNA, 756 bp, Artificial Sequence
  Engineered Variant of Kred from Lactobacillus kefir
atgaccgatcgtctgaagcataaagtagccatcgttaccggcgggacaatgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggttattaaaagcgttgaagacactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgatccgactctgggggcatacaacgcttccaagggggcggtacgtatcatgtcgaaaagcgcagcgctggattgcgcactgaaggactacgatgtgcgtgtcaacacagtacatccgggcgcgatcaagaccccacggaaggatgctctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 164 - protein, 252 aa, Artificial Sequence
  Engineered Variant of Kred from Lactobacillus kefir
MTDRLKHKVAIVTGGTMGIGLAIADKFVEEGAKVVITGRHADVGEKAAKSIGGTDVIRFVQHDASEEAGWTKLFDTTEEAFGPVTTLVNNAGIGVIKSVEDTTTEEWRKILSVNLDGVFFGTRLGIQRMKNKGLGASIINMSSIMGLVGDPTLGAYNASKGAVRIMSKSAALDCALKDYDVRVNTVHPGAIKTPRKDALEGWEEMMSQRTLTPMGHIGEPNDIAWICVYLASDESKFATGAEFVVDGGWTAQ

SEQ ID NO: 165 - DNA, 756 bp, Artificial Sequence
  Engineered Variant of Kred from Lactobacillus kefir
atgaccgatcgtctgaagcataaagtagccatcgttaccggcgggacaatgggtatcggtttggcaatcgccgataaatttgtagaggagggtgcgaaagtagttattactggtcgtcacgcggatgtaggtgaagtagccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggttattaaaagcgttgaagacactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgatccgactctgggggcatacaacgcttccaagggggcggtacgtatcatgtcgaaaagcgcagcgctggattgcgcactgaaggactacgatgtgcgtgtcaacacagtacatccgggccccatcaagaccccgcggaaggatgctctggaaggttgggaggaaatgatgtcacagcgtacgcgtacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 166 - protein, 252 aa, Artificial Sequence
  Engineered Variant of Kred from Lactobacillus kefir
MTDRLKHKVAIVTGGTMGIGLAIADKFVEEGAKVVITGRHADVGEVAAKSIGGTDVIRFVQHDASEEAGWTKLFDTTEEAFGPVTTLVNNAGIGVIKSVEDTTTEEWRKILSVNLDGVFFGTRLGIQRMKNKGLGASIINMSSIMGLVGDPTLGAYNASKGAVRIMSKSAALDCALKDYDVRVNTVHPGPIKTPRKDALEGWEEMMSQRTRTPMGHIGEPNDIAWICVYLASDESKFATGAEFVVDGGWTAQ

SEQ ID NO: 167 - DNA, 756 bp, Artificial Sequence
  Engineered Variant of Kred from Lactobacillus kefir
atgaccgatcgtctgaagcataaagtagccatcgttaccggcgggacacagggtatcggtttggcaatcgccgataaatttgtagaggagggtgcgaaagtagttattactggtcgtcacgcggatgtaggtgaagtagccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggttattaaaagcgttgaagacactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgatccgactctgggggcatacaacgcttccaagggggcggtacgtatcatgtcgaaaagcgcagcgctggattgcgcactgaaggactacgatgtgcgtgtcaacacagtacatccgggcccgatcaagaccgagcggaaggatcagctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 168 - protein, 252 aa, Artificial Sequence
  Engineered Variant of Kred from Lactobacillus kefir
MTDRLKHKVAIVTGGTQGIGLAIADKFVEEGAKVVITGRHADVGEVAAKSIGGTDVIRFVQHDASEEAGWTKLFDTTEEAFGPVTTLVNNAGIGVIKSVEDTTTEEWRKILSVNLDGVFFGTRLGIQRMKNKGLGASIINMSSIMGLVGDPTLGAYNASKGAVRIMSKSAALDCALKDYDVRVNTVHPGPIKTERKDQLEGWEEMMSQRTLTPMGHIGEPNDIAWICVYLASDESKFATGAEFVVDGGWTAQ

SEQ ID NO: 169 - DNA, 756 bp, Artificial Sequence
  Engineered Variant of Kred from Lactobacillus kefir
atgaccgatcgtctgaagcataaagtagccatcgttaccggcgggacaatgggtatcggtttggcaatcgccgataaatttgtagaggagggtgcgaaagtagttattactggtcgtcacgcggatgtaggtgaagtagccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggttattaaaagcgttgaagacactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgatccgactctgggggcatacaacgcttccaagggggcggtacgtatcatgtcgaaaagcgcagcgctggattgcgcactgaaggactacgatgtgcgtgtcaacacagtacatccgggcgcgatcaagaccccacggaaggatgatctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 170 - protein, 252 aa, Artificial Sequence
  Engineered Variant of Kred from Lactobacillus kefir
MTDRLKHKVAIVTGGTMGIGLAIADKFVEEGAKVVITGRHADVGEVAAKSIGGTDVIRFVQHDASEEAGWTKLFDTTEEAFGPVTTLVNNAGIGVIKSVEDTTTEEWRKILSVNLDGVFFGTRLGIQRMKNKGLGASIINMSSIMGLVGDPTLGAYNASKGAVRIMSKSAALDCALKDYDVRVNTVHPGAIKTPRKDDLEGWEEMMSQRTLTPMGHIGEPNDIAWICVYLASDESKFATGAEFVVDGGWTAQ

SEQ ID NO: 171 - DNA, 756 bp, Artificial Sequence
  Engineered Variant of Kred from Lactobacillus kefir
atgaccgatcgtctgaagcataaagtagccatcgttaccggcgggacaatgggtatcggtttggcaatcgccgataaatttgtagaggagggtgcgaaagtagttattactggtcgtcacgcggatgtaggtgaaaaagccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggttattaaaagcgttgaagacactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgatccgactctgggggcatacaacgcttccaagggggcggtacgtatcatgtcgaaaagcgcagcgctggattgcgcactgaaggactacgatgtgcgtgtcaacacagtacatccgggcgcgatcaagaccccacggaaggatcagctggaaggttgggaggaaatgatgtcacagcgtacgctgacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 172 - protein, 252 aa, Artificial Sequence
  Engineered Variant of Kred from Lactobacillus kefir
MTDRLKHKVAIVTGGTMGIGLAIADKFVEEGAKVVITGRHADVGEKAAKSIGGTDVIRFVQHDASEEAGWTKLFDTTEEAFGPVTTLVNNAGIGVIKSVEDTTTEEWRKILSVNLDGVFFGTRLGIQRMKNKGLGASIINMSSIMGLVGDPTLGAYNASKGAVRIMSKSAALDCALKDYDVRVNTVHPGAIKTPRKDQLEGWEEMMSQRTLTPMGHIGEPNDIAWICVYLASDESKFATGAEFVVDGGWTAQ

SEQ ID NO: 173 - DNA, 756 bp, Artificial Sequence
  Engineered Variant of Kred from Lactobacillus kefir
atgaccgatcgtctgaagcataaagtagccatcgttaccggcgggacacagggtatcggtttggcaatcgccgataaatttgtagaggagggtgcgaaagtagttattactggtcgtcacgcggatgtaggtgaagtagccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggttattaaaagcgttgaagacactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgatccgactctgggggcatacaacgcttccaagggggcggtacgtatcatgtcgaaaagcgcagcgctggattgcgcactgaaggactacgatgtgcgtgtcaacacagtacatccgggcgcgatcaagaccgagcggaaggatcagctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 174 - protein, 252 aa, Artificial Sequence
  Engineered Variant of Kred from Lactobacillus kefir
MTDRLKHKVAIVTGGTQGIGLAIADKFVEEGAKVVITGRHADVGEVAAKSIGGTDVIRFVQHDASEEAGWTKLFDTTEEAFGPVTTLVNNAGIGVIKSVEDTTTEEWRKILSVNLDGVFFGTRLGIQRMKNKGLGASIINMSSIMGLVGDPTLGAYNASKGAVRIMSKSAALDCALKDYDVRVNTVHPGAIKTERKDQLEGWEEMMSQRTLTPMGHIGEPNDIAWICVYLASDESKFATGAEFVVDGGWTAQ

SEQ ID NO: 175 - DNA, 756 bp, Artificial Sequence
  Engineered Variant of Kred from Lactobacillus kefir
atgaccgatcgtctgaagcataaagtagccatcgttaccggcgggacaatgggtatcggtttggcaatcgccgataaatttgtagaggagggtgcgaaagtagttattactggtcgtcacgcggatgtaggtgaaaaagccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggttgttaaaagcgttgaagacactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgatccgactctgggggcatacaacgcttccaagggggcggtacgtatcatgtcgaaaagcgcagcgctggattgcgcactgaaggactacgatgtgcgtgtcaacacagtacatccgggcccgatcaagaccgagcggaaggatcagctggaaggttgggaggaaatgatgtcacagcgtacgttaacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 176 - protein, 252 aa, Artificial Sequence
  Engineered Variant of Kred from Lactobacillus kefir
MTDRLKHKVAIVTGGTMGIGLAIADKFVEEGAKVVITGRHADVGEKAAKSIGGTDVIRFVQHDASEEAGWTKLFDTTEEAFGPVTTLVNNAGIGVVKSVEDTTTEEWRKILSVNLDGVFFGTRLGIQRMKNKGLGASIINMSSIMGLVGDPTLGAYNASKGAVRIMSKSAALDCALKDYDVRVNTVHPGPIKTERKDQLEGWEEMMSQRTLTPMGHIGEPNDIAWICVYLASDESKFATGAEFVVDGGWTAQ

SEQ ID NO: 177 - DNA, 756 bp, Artificial Sequence
  Engineered Variant of Kred from Lactobacillus kefir
atgaccgatcgtctgaagcataaagtagccatcgttaccggcgggacaatgggtatcggtttggcaatcgccgataaatttgtagaggagggtgcgaaagtagttattactggtcgtcacgcggatgtaggtgaaaaagccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggttattaaaagcgttgaagacactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgatccgactctgggggcatacaacgcttccaagggggcggtacgtatcatgtcgaaaagcgcagcgctggattgcgcactgaaggactacgatgtgcgtgtcaacacagtacatccgggcgcgatcaagaccccacggaaggatcagctggaaggttgggagcagatgatgtcacagcgtacgctgacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 178 - protein, 252 aa, Artificial Sequence
  Engineered Variant of Kred from Lactobacillus kefir
MTDRLKHKVAIVTGGTMGIGLAIADKFVEEGAKVVITGRHADVGEKAAKSIGGTDVIRFVQHDASEEAGWTKLFDTTEEAFGPVTTLVNNAGIGVIKSVEDTTTEEWRKILSVNLDGVFFGTRLGIQRMKNKGLGASIINMSSIMGLVGDPTLGAYNASKGAVRIMSKSAALDCALKDYDVRVNTVHPGAIKTPRKDQLEGWEQMMSQRTLTPMGHIGEPNDIAWICVYLASDESKFATGAEFVVDGGWTAQ

SEQ ID NO: 179 - DNA, 756 bp, Artificial Sequence
  Engineered Variant of Kred from Lactobacillus kefir
atgaccgatcgtctgaagcataaagtagccatcgttaccggcgggacaatgggtatcggtttggcaatcgccgataaatttgtagaggagggtgcgaaagtagttattactggtcgtcacgcggatgtaggtgaaaaagccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggttattaaaagcgttgaagacactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgatccgactctgggggcatacaacgcttccaagggggcggtacgtatcatgtcgaaaagcgcagcgctggattgcgcactgaaggactacgatgtgcgtgtcaacacagtacatccgggcgcgatcaagaccccacggaaggatcagctggaaggttgggaggaaatgatgtcacagcgtacgctgacccctatgggccacattggcgaaccgaatgacatcgcatgggtgtgtgtgtacctggcatctgacgaatcgaaatttgcgacgggtgcagaatttgtggtcgacggcgggtggaccgcacag

SEQ ID NO: 180 - protein, 252 aa, Artificial Sequence
  Engineered Variant of Kred from Lactobacillus kefir
MTDRLKHKVAIVTGGTMGIGLAIADKFVEEGAKVVITGRHADVGEKAAKSIGGTDVIRFVQHDASEEAGWTKLFDTTEEAFGPVTTLVNNAGIGVIKSVEDTTTEEWRKILSVNLDGVFFGTRLGIQRMKNKGLGASIINMSSIMGLVGDPTLGAYNASKGAVRIMSKSAALDCALKDYDVRVNTVHPGAIKTPRKDQLEGWEEMMSQRTLTPMGHIGEPNDIAWVCVYLASDESKFATGAEFVVDGGWTAQ

SEQ ID NO: 181 - DNA, 756 bp, Artificial Sequence
  Engineered Variant of Kred from Lactobacillus kefir
atgaccgatcgtctgaagcataaagtagccatcgttaccggcgggacaatgggtatcggtttggcaatcgccgataaatttgtagaggagggtgcgaaagtagttattactggtcgtcacgcggatgtaggtgaaaaagccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggttattaaaagcgttgaatatactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgatccgactctgggggcatacaacgcttccaagggggcggtacgtatcatgtcgaaaagcgcagcgctggattgcgcactgaaggactacgatgtgcgtgtcaacacagtacatccgggcgcgatcaagaccccacggaaggatcagctggaaggttgggaggaaatgatgtcacagcgtacgctgacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 182 - protein, 252 aa, Artificial Sequence
  Engineered Variant of Kred from Lactobacillus kefir
MTDRLKHKVAIVTGGTMGIGLAIADKFVEEGAKVVITGRHADVGEKAAKSIGGTDVIRFVQHDASEEAGWTKLFDTTEEAFGPVTTLVNNAGIGVIKSVEYTTTEEWRKILSVNLDGVFFGTRLGIQRMKNKGLGASIINMSSIMGLVGDPTLGAYNASKGAVRIMSKSAALDCALKDYDVRVNTVHPGAIKTPRKDQLEGWEEMMSQRTLTPMGHIGEPNDIAWICVYLASDESKFATGAEFVVDGGWTAQ

SEQ ID NO: 183 - DNA, 756 bp, Artificial Sequence
  Engineered Variant of Kred from Lactobacillus kefir
atgaccgatcgtctgaagcataaagtagccatcgttaccggcgggacaatgggtatcggtttggcaatcgccgataaatttgtagaggagggtgcgaaagtagttattactggtcgtcacgcggatgtaggtgaaaaagccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggttattaaaagcgttgaagacactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgatccgactctgggggcatacaacgcttccaagggggcggtacgtatcatgtcgaaaagcgcagcgctggattgcgcactgaaggacatggatgtgcgtgtcaacacagtacatccgggcgcgatcaagaccccacggaaggatcagctggaaggttgggaggaaatgatgtcacagcgtacgctgacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 184 - protein, 252 aa, Artificial Sequence
  Engineered Variant of Kred from Lactobacillus kefir
MTDRLKHKVAIVTGGTMGIGLAIADKFVEEGAKVVITGRHADVGEKAAKSIGGTDVIRFVQHDASEEAGWTKLFDTTEEAFGPVTTLVNNAGIGVIKSVEDTTTEEWRKILSVNLDGVFFGTRLGIQRMKNKGLGASIINMSSIMGLVGDPTLGAYNASKGAVRIMSKSAALDCALKDMDVRVNTVHPGAIKTPRKDQLEGWEEMMSQRTLTPMGHIGEPNDIAWICVYLASDESKFATGAEFVVDGGWTAQ

SEQ ID NO: 185 - DNA, 756 bp, Artificial Sequence
  Engineered Variant of Kred from Lactobacillus kefir
atgaccgatcgtctgaagcataaagtagccatcgttaccggcgggacaatgggtatcggtttggcaatcgccgataaatttgtagaggagggtgcgaaagtagttattactggtcgtcacgcggatgtaggtgaaaaagccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggttattaaaagcgttgaacggactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgatccgactctgggggcatacaacgcttccaagggggcggtacgtatcatgtcgaaaagcgcagcgctggattgcgcactgaaggactacgatgtgcgtgtcaacacagtacatccgggcgcgatcaagaccccacggaaggatcagctggaaggttgggaggaaatgatgtcacagcgtacgctgacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 186 - protein, 252 aa, Artificial Sequence
  Engineered Variant of Kred from Lactobacillus kefir
MTDRLKHKVAIVTGGTMGIGLAIADKFVEEGAKVVITGRHADVGEKAAKSIGGTDVIRFVQHDASEEAGWTKLFDTTEEAFGPVTTLVNNAGIGVIKSVERTTTEEWRKILSVNLDGVFFGTRLGIQRMKNKGLGASIINMSSIMGLVGDPTLGAYNASKGAVRIMSKSAALDCALKDYDVRVNTVHPGAIKTPRKDQLEGWEEMMSQRTLTPMGHIGEPNDIAWICVYLASDESKFATGAEFVVDGGWTAQ

SEQ ID NO: 187 - DNA, 756 bp, Artificial Sequence
  Engineered Variant of Kred from Lactobacillus kefir
atgaccgatcgtctgaagcataaagtagccatcgttaccggcgggacaatgggtatcggtttggcaatcgccgataaatttgtagaggagggtgcgaaagtagttattactggtcgtcacgcggatgtaggtgaaaaagccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggttattaaaagcgttgaagacactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgatccgactctgggggcatacaacgcttccaagggggcggtacgtatcatgtcgaaaagcgcagcgctggattgcgcactgaaggactacgatgtgcgtgtcaacacagtacatccgggcgcgatcaagaccccacggaaggatcagctggaaggttgggaggaaatgatgtcacagcgtacgctgacccctatgggccacattggcgaaccgaatgacatcgcatggatctgtgtgtacctggggtctgacgaatcgaaatttgcgacgggtgcagaatttgtggtcgacggcgggtggaccgcacag

SEQ ID NO: 188 - protein, 252 aa, Artificial Sequence
  Engineered Variant of Kred from Lactobacillus kefir
MTDRLKHKVAIVTGGTMGIGLAIADKFVEEGAKVVITGRHADVGEKAAKSIGGTDVIRFVQHDASEEAGWTKLFDTTEEAFGPVTTLVNNAGIGVIKSVEDTTTEEWRKILSVNLDGVFFGTRLGIQRMKNKGLGASIINMSSIMGLVGDPTLGAYNASKGAVRIMSKSAALDCALKDYDVRVNTVHPGAIKTPRKDQLEGWEEMMSQRTLTPMGHIGEPNDIAWICVYLGSDESKFATGAEFVVDGGWTAQ

SEQ ID NO: 189 - DNA, 756 bp, Artificial Sequence
  Engineered Variant of Kred from Lactobacillus kefir
atgaccgatcgtctgaagcataaagtagccatcgttaccggcgggacaatgggtatcggtttggcaatcgccgataaatttgtagaggagggtgcgaaagtagttattactggtcgtcacgcggatgtaggtgaaaaagccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggttattaaaagcgttgaagacactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgatccgactctgggggcatacaacgcttccaagggggcggtacgtatcatgtcgaaaagcgcagcgctggattgcgcactgaaggactacgatgtgcgtgtcaacacagtacatccgggcgcgatcaagaccgagcggaaggatcagctggaaggttgggaggaaatgatgtcacagcgtacgctgacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 190 - protein, 252 aa, Artificial Sequence
  Engineered Variant of Kred from Lactobacillus kefir
MTDRLKHKVAIVTGGTMGIGLAIADKFVEEGAKVVITGRHADVGEKAAKSIGGTDVIRFVQHDASEEAGWTKLFDTTEEAFGPVTTLVNNAGIGVIKSVEDTTTEEWRKILSVNLDGVFFGTRLGIQRMKNKGLGASIINMSSIMGLVGDPTLGAYNASKGAVRIMSKSAALDCALKDYDVRVNTVHPGAIKTERKDQLEGWEEMMSQRTLTPMGHIGEPNDIAWICVYLASDESKFATGAEFVVDGGWTAQ

SEQ ID NO: 191 - DNA, 756 bp, Artificial Sequence
  Engineered Variant of Kred from Lactobacillus kefir
atgaccgatcgtctgaagcataaagtagccatcgttaccggcgggacaatgggtatcggtttggcaatcgccgataaatttgtagaggagggtgcgaaagtagttattactggtcgtcacgcggatgtaggtttgaaggccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggttattaaaagcgttgaagacactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgatccgactctgggggcatacaacgcttccaagggggcggtacgtatcatgtcgaaaagcgcagcgctggattgcgcactgaaggactacgatgtgcgtgtcaacacagtacatccgggcgcgatcaagaccccacggaaggatcagctggaaggttgggaggaaatgatgtcacagcgtacgctgacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 192 - protein, 252 aa, Artificial Sequence
  Engineered Variant of Kred from Lactobacillus kefir
MTDRLKHKVAIVTGGTMGIGLAIADKFVEEGAKVVITGRHADVGLKAAKSIGGTDVIRFVQHDASEEAGWTKLFDTTEEAFGPVTTLVNNAGIGVIKSVEDTTTEEWRKILSVNLDGVFFGTRLGIQRMKNKGLGASIINMSSIMGLVGDPTLGAYNASKGAVRIMSKSAALDCALKDYDVRVNTVHPGAIKTPRKDQLEGWEEMMSQRTLTPMGHIGEPNDIAWICVYLASDESKFATGAEFVVDGGWTAQ

SEQ ID NO: 193 - DNA, 756 bp, Artificial Sequence
  Engineered Variant of Kred from Lactobacillus kefir
atgaccgatcgtctgaagcataaagtagccatcgttaccggcgggacaatgggtatcggtttggcaatcgccgataaatttgtagaggagggtgcgaaagtagttattactggtcgtcacgcggatgtaggtgaaaaagccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggtaattaagagcgttgaacggactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgctccgactgcaggggcatacaacgcttccaagggggcggtacgtatcatgtcgaaaagcgcagcgctggattgcgcactgaaggactacgatgtgcgtgtcaacacagtacatccgggcgcgatcaagaccccacggaaggatcagctggaaggttgggaggaagcaatgtcacagcgtacggcgacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 194 - protein, 252 aa, Artificial Sequence
  Engineered Variant of Kred from Lactobacillus kefir
MTDRLKHKVAIVTGGTMGIGLAIADKFVEEGAKVVITGRHADVGEKAAKSIGGTDVIRFVQHDASEEAGWTKLFDTTEEAFGPVTTLVNNAGIGVIKSVERTTTEEWRKILSVNLDGVFFGTRLGIQRMKNKGLGASIINMSSIMGLVGAPTAGAYNASKGAVRIMSKSAALDCALKDYDVRVNTVHPGAIKTPRKDQLEGWEEAMSQRTATPMGHIGEPNDIAWICVYLASDESKFATGAEFVVDGGWTAQ

SEQ ID NO: 195 - DNA, 756 bp, Artificial Sequence
  Engineered Variant of Kred from Lactobacillus kefir
atgaccgatcgtctgaagcataaagtagccatcgttaccggcgggacaatgggtatcggtttggcaatcgccgataaatttgtagaggagggtgcgaaagtagttattactggtcgtcacgcggatgtaggtgaaaaagccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggtaattaagagcgttgaacggactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgctccgactgcaggggcatacaacgcttccaagggggcggtacgtatcatgtcgaaaagcgcagcgctggattgcgcactgaaggactacgatgtgcgtgtcaacacagtacatccgggcgcgatcaagaccccacggaaggatcagctggaaggttgggaggaaatgatgtcacagcgtacggcgacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 196 - protein, 252 aa, Artificial Sequence
  Engineered Variant of Kred from Lactobacillus kefir
MTDRLKHKVAIVTGGTMGIGLAIADKFVEEGAKVVITGRHADVGEKAAKSIGGTDVIRFVQHDASEEAGWTKLFDTTEEAFGPVTTLVNNAGIGVIKSVERTTTEEWRKILSVNLDGVFFGTRLGIQRMKNKGLGASIINMSSIMGLVGAPTAGAYNASKGAVRIMSKSAALDCALKDYDVRVNTVHPGAIKTPRKDQLEGWEEMMSQRTATPMGHIGEPNDIAWICVYLASDESKFATGAEFVVDGGWTAQ

SEQ ID NO: 197 - DNA, 756 bp, Artificial Sequence
  Engineered Variant of Kred from Lactobacillus kefir
atgaccgatcgtctgaagcataaagtagccatcgttaccggcgggacaatgggtatcggtttggcaatcgccgataaatttgtagaggagggtgcgaaagtagttattactggtcgtcacgcggatgtaggtgaaaaagccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggcaattgcgagcgttgaacggactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgctccgactgcaggggcatacaacgcttccaagggggcggtacgtatcatgtcgaaaagcgcagcgctggattgcgcactgaaggactacgatgtgcgtgtcaacacagtacatccgggcgcgatcaagaccccacggaaggatcagctggaaggttgggaggaaatgatgtcacagcgtacgctgacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 198 - protein, 252 aa, Artificial Sequence
  Engineered Variant of Kred from Lactobacillus kefir
MTDRLKHKVAIVTGGTMGIGLAIADKFVEEGAKVVITGRHADVGEKAAKSIGGTDVIRFVQHDASEEAGWTKLFDTTEEAFGPVTTLVNNAGIGAIASVERTTTEEWRKILSVNLDGVFFGTRLGIQRMKNKGLGASIINMSSIMGLVGAPTAGAYNASKGAVRIMSKSAALDCALKDYDVRVNTVHPGAIKTPRKDQLEGWEEMMSQRTLTPMGHIGEPNDIAWICVYLASDESKFATGAEFVVDGGWTAQ

SEQ ID NO: 199 - DNA, 756 bp, Artificial Sequence
  Engineered Variant of Kred from Lactobacillus kefir
atgaccgatcgtctgaagcataaagtagccatcgttaccggcgggacaatgggtatcggtttggcaatcgccgataaatttgtagaggagggtgcgaaagtagttattactggtcgtcacgcggatgtaggtgaaaaagccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggcaattaagagcgttgaacggactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgctccgactgcaggggcatacaacgcttccaagggggcggtacgtatcatgtcgaaaagcgcagcgctggattgcgcactgaaggactacgatgtgcgtgtcaacacagtacatccgggcgcgatcaagaccccacggaaggatcagctggaaggttgggaggaagcaatgtcacagcgtacggcgacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 200 - protein, 252 aa, Artificial Sequence
  Engineered Variant of Kred from Lactobacillus kefir
MTDRLKHKVAIVTGGTMGIGLAIADKFVEEGAKVVITGRHADVGEKAAKSIGGTDVIRFVQHDASEEAGWTKLFDTTEEAFGPVTTLVNNAGIGAIKSVERTTTEEWRKILSVNLDGVFFGTRLGIQRMKNKGLGASIINMSSIMGLVGAPTAGAYNASKGAVRIMSKSAALDCALKDYDVRVNTVHPGAIKTPRKDQLEGWEEAMSQRTATPMGHIGEPNDIAWICVYLASDESKFATGAEFVVDGGWTAQ

SEQ ID NO: 201 - DNA, 756 bp, Artificial Sequence
  Engineered Variant of Kred from Lactobacillus kefir
atgaccgatcgtctgaagcataaagtagccatcgttaccggcgggacaatgggtatcggtttggcaatcgccgataaatttgtagaggagggtgcgaaagtagttattactggtcgtcacgcggatgtaggtgaaaaagccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggtaattgcgagcgttgaacggactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgctccgactgcaggggcatacaacgcttccaagggggcggtacgtatcatgtcgaaaagcgcagcgctggattgcgcactgaaggactacgatgtgcgtgtcaacacagtacatccgggcgcgatcaagaccccacggaaggatcagctggaaggttgggaggaaatgatgtcacagcgtacgctgacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 202 - protein, 252 aa, Artificial Sequence
  Engineered Variant of Kred from Lactobacillus kefir
MTDRLKHKVAIVTGGTMGIGLAIADKFVEEGAKVVITGRHADVGEKAAKSIGGTDVIRFVQHDASEEAGWTKLFDTTEEAFGPVTTLVNNAGIGVIASVERTTTEEWRKILSVNLDGVFFGTRLGIQRMKNKGLGASIINMSSIMGLVGAPTAGAYNASKGAVRIMSKSAALDCALKDYDVRVNTVHPGAIKTPRKDQLEGWEEMMSQRTLTPMGHIGEPNDIAWICVYLASDESKFATGAEFVVDGGWTAQ

SEQ ID NO: 203 - DNA, 756 bp, Artificial Sequence
  Engineered Variant of Kred from Lactobacillus kefir
atgaccgatcgtctgaagcataaagtagccatcgttaccggcgggacaatgggtatcggtttggcaatcgccgataaatttgtagaggagggtgcgaaagtagttattactggtcgtcacgcggatgtaggtgaaaaagccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggttattaaaagcgttgaacggactaccacggaggaatggcgtaaaatcctgtccgttaatctggatggtgtttttttcggcacccgtctgggcattcagcgcatgaaaaataaaggcttgggcgctagcatcatcaatatgagctcgatcgcggggctcgtaggcgatccgactgcaggggcatacaacgcttccaagggggcggtacgtatcatgtcgaaaagcgcagcgctggattgcgcactgaaggactacgatgtgcgtgtcaacacagtacatccgggcgcgatcaagaccccacggaaggatcagctggaaggttgggaggaaatgatgtcacagcgtacggcgacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 204 - protein, 252 aa, Artificial Sequence
  Engineered Variant of Kred from Lactobacillus kefir
MTDRLKHKVAIVTGGTMGIGLAIADKFVEEGAKVVITGRHADVGEKAAKSIGGTDVIRFVQHDASEEAGWTKLFDTTEEAFGPVTTLVNNAGIGVIKSVERTTTEEWRKILSVNLDGVFFGTRLGIQRMKNKGLGASIINMSSIAGLVGDPTAGAYNASKGAVRIMSKSAALDCALKDYDVRVNTVHPGAIKTPRKDQLEGWEEMMSQRTATPMGHIGEPNDIAWICVYLASDESKFATGAEFVVDGGWTAQ

SEQ ID NO: 205 - DNA, 756 bp, Artificial Sequence
  Engineered Variant of Kred from Lactobacillus kefir
atgaccgatcgtctgaagcataaagtagccatcgttaccggcgggacaatgggtatcggtttggcaatcgccgataaatttgtagaggagggtgcgaaagtagttattactggtcgtcacgcggatgtaggtgaaaaagccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggtagccaagagcgttgaacggactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgctccgactgcaggggcatacaacgcttccaagggggcggtacgtatcatgtcgaaaagcgcagcgctggattgcgcactgaaggactacgatgtgcgtgtcaacacagtacatccgggcgcgatcaagaccccacggaaggatcagctggaaggttgggaggaaatgatgtcacagcgtacgctgacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 206 - protein, 252 aa, Artificial Sequence
  Engineered Variant of Kred from Lactobacillus kefir
MTDRLKHKVAIVTGGTMGIGLAIADKFVEEGAKVVITGRHADVGEKAAKSIGGTDVIRFVQHDASEEAGWTKLFDTTEEAFGPVTTLVNNAGIGVAKSVERTTTEEWRKILSVNLDGVFFGTRLGIQRMKNKGLGASIINMSSIMGLVGAPTAGAYNASKGAVRIMSKSAALDCALKDYDVRVNTVHPGAIKTPRKDQLEGWEEMMSQRTLTPMGHIGEPNDIAWICVYLASDESKFATGAEFVVDGGWTAQ

SEQ ID NO: 207 - DNA, 756 bp, Artificial Sequence
  Engineered Variant of Kred from Lactobacillus kefir
atgaccgatcgtctgaagcataaagtagccatcgttaccggcgggacaatgggtatcggtttggcaatcgccgataaatttgtagaggagggtgcgaaagtagttattactggtcgtcacgcggatgtaggtgaaaaagccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggtaattgcgagcgttgaacggactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgctccgactgcaggggcatacaacgcttccaagggggcggtacgtatcatgtcgaaaagcgcagcgctggattgcgcactgaaggactacgatgtgcgtgtcaacacagtacatccgggcgcgatcaagaccccacggaaggatcagctggaaggttgggaggaagcaatgtcacagcgtacggcgacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 208 - protein, 252 aa, Artificial Sequence
  Engineered Variant of Kred from Lactobacillus kefir
MTDRLKHKVAIVTGGTMGIGLAIADKFVEEGAKVVITGRHADVGEKAAKSIGGTDVIRFVQHDASEEAGWTKLFDTTEEAFGPVTTLVNNAGIGVIASVERTTTEEWRKILSVNLDGVFFGTRLGIQRMKNKGLGASIINMSSIMGLVGAPTAGAYNASKGAVRIMSKSAALDCALKDYDVRVNTVHPGAIKTPRKDQLEGWEEAMSQRTATPMGHIGEPNDIAWICVYLASDESKFATGAEFVVDGGWTAQ

SEQ ID NO: 209 - DNA, 756 bp, Artificial Sequence
  Engineered Variant of Kred from Lactobacillus kefir
atgaccgatcgtctgaagcataaagtagccatcgttaccggcgggacaatgggtatcggtttggcaatcgccgataaatttgtagaggagggtgcgaaagtagttattactggtcgtcacgcggatgtaggtgaaaaagccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggcaattaagagcgttgaacggactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgctccgactgcaggggcatacaacgcttccaagggggcggtacgtatcatgtcgaaaagcgcagcgctggattgcgcactgaaggactacgatgtgcgtgtcaacacagtacatccgggcgcgatcaagaccccacggaaggatcagctggaaggttgggaggaagcagcttcacagcgtacggcgacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 210 - protein, 252 aa, Artificial Sequence
  Engineered Variant of Kred from Lactobacillus kefir
MTDRLKHKVAIVTGGTMGIGLAIADKFVEEGAKVVITGRHADVGEKAAKSIGGTDVIRFVQHDASEEAGWTKLFDTTEEAFGPVTTLVNNAGIGAIKSVERTTTEEWRKILSVNLDGVFFGTRLGIQRMKNKGLGASIINMSSIMGLVGAPTAGAYNASKGAVRIMSKSAALDCALKDYDVRVNTVHPGAIKTPRKDQLEGWEEAASQRTATPMGHIGEPNDIAWICVYLASDESKFATGAEFVVDGGWTAQ

SEQ ID NO: 211 - DNA, 756 bp, Artificial Sequence
  Engineered Variant of Kred from Lactobacillus kefir
atgaccgatcgtctgaagcataaagtagccatcgttaccggcgggacaatgggtatcggtttggcaatcgccgataaatttgtagaggagggtgcgaaagtagttattactggtcgtcacgcggatgtaggtgaaaaagccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggtaattgcgagcgttgaacggactaccacggaggaatggcgtaaaatcctgtccgttaatctggatggtgtttttttcggcacccgtctgggcattcagcgcatgaaaaataaaggcttgggcgctagcatcatcaatatgagctcgatcatggggctcgtaggcgctccgactgcaggggcatacaacgcttccaagggggcggtacgtatcatgtcgaaaagcgcagcgctggattgcgcactgaaggactacgatgtgcgtgtcaacacagtacatccgggcgcgatcaagaccccacggaaggatcagctggaaggttgggaggaagcaatgtcacagcgtacgctgacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 212 - protein, 252 aa, Artificial Sequence
  Engineered Variant of Kred from Lactobacillus kefir
MTDRLKHKVAIVTGGTMGIGLAIADKFVEEGAKVVITGRHADVGEKAAKSIGGTDVIRFVQHDASEEAGWTKLFDTTEEAFGPVTTLVNNAGIGVIASVERTTTEEWRKILSVNLDGVFFGTRLGIQRMKNKGLGASIINMSSIMGLVGAPTAGAYNASKGAVRIMSKSAALDCALKDYDVRVNTVHPGAIKTPRKDQLEGWEEAMSQRTLTPMGHIGEPNDIAWICVYLASDESKFATGAEFVVDGGWTAQ

SEQ ID NO: 213 - DNA, 756 bp, Artificial Sequence
  Engineered Variant of Kred from Lactobacillus kefir
atgaccgatcgtctgaagcataaagtagccatcgttaccggcgggacaatgggtatcggtttggcaatcgccgataaatttgtagaggagggtgcgaaagtagttattactggtcgtcacgcggatgtaggtgaaaaagccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggttattaaaagcgttgaacggactaccacggaggaatggcgtaaaatcctgtccgttaatctggatggtgtttttttcggcacccgtctgggcattcagcgcatgaaaaataaaggcttgggcgctagcatcatcaatatgagctcgatcatggggctcgtaggcgctccgactgcaggggcatacaacgcttccaagggggcggtacgtatcatgtcgaaaagcgcagcgctggattgcgcactgaaggactacgatgtgcgtgtcaacacagtacatccgggcgcgatcaagaccccacggaaggatcagctggaaggttgggaggaaatggcttcacagcgtacggcgacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 214 - protein, 252 aa, Artificial Sequence
  Engineered Variant of Kred from Lactobacillus kefir
MTDRLKHKVAIVTGGTMGIGLAIADKFVEEGAKVVITGRHADVGEKAAKSIGGTDVIRFVQHDASEEAGWTKLFDTTEEAFGPVTTLVNNAGIGVIKSVERTTTEEWRKILSVNLDGVFFGTRLGIQRMKNKGLGASIINMSSIMGLVGAPTAGAYNASKGAVRIMSKSAALDCALKDYDVRVNTVHPGAIKTPRKDQLEGWEEMASQRTATPMGHIGEPNDIAWICVYLASDESKFATGAEFVVDGGWTAQ

SEQ ID NO: 215 - DNA, 756 bp, Artificial Sequence
  Engineered Variant of Kred from Lactobacillus kefir
atgaccgatcgtctgaagcataaagtagccatcgttaccggcgggacaatgggtatcggtttggcaatcgccgataaatttgtagaggagggtgcgaaagtagttattactggtcgtcacgcggatgtaggtgaaaaagccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggttattaaaagcgttgaacggactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgctccgactgcaggggcatacaacgcttccaagggggcggtacgtatcatgtcgaaaagcgcagcgctggattgcgcactgaaggactacgatgtgcgtgtcaacacagtacatccgggcgcgatcaagaccccacggaaggatcagctggaaggttgggaggaaatggcttcacagcgtacggcgacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 216 - protein, 252 aa, Artificial Sequence; identical to SEQ ID NO: 214
  Engineered Variant of Kred from Lactobacillus kefir

SEQ ID NO: 217 - DNA, 756 bp, Artificial Sequence
  Engineered Variant of Kred from Lactobacillus kefir
atgaccgatcgtctgaagcataaagtagccatcgttaccggcgggacaatgggtatcggtttggcaatcgccgataaatttgtagaggagggtgcgaaagtagttattactggtcgtcacgcggatgtaggtgaaaaagccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggcagccgcgagcgttgaacggactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgctccgactgcaggggcatacaacgcttccaagggggcggtacgtatcatgtcgaaaagcgcagcgctggattgcgcactgaaggactacgatgtgcgtgtcaacacagtacatccgggcgcgatcaagaccccacggaaggatcagctggaaggttgggaggaagcaatgtcacagcgtacgctgacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 218 - protein, 252 aa, Artificial Sequence
  Engineered Variant of Kred from Lactobacillus kefir
MTDRLKHKVAIVTGGTMGIGLAIADKFVEEGAKVVITGRHADVGEKAAKSIGGTDVIRFVQHDASEEAGWTKLFDTTEEAFGPVTTLVNNAGIGAAASVERTTTEEWRKILSVNLDGVFFGTRLGIQRMKNKGLGASIINMSSIMGLVGAPTAGAYNASKGAVRIMSKSAALDCALKDYDVRVNTVHPGAIKTPRKDQLEGWEEAMSQRTLTPMGHIGEPNDIAWICVYLASDESKFATGAEFVVDGGWTAQ

SEQ ID NO: 219 - DNA, 756 bp, Artificial Sequence
  Engineered Variant of Kred from Lactobacillus kefir
atgaccgatcgtctgaagcataaagtagccatcgttaccggcgggacaatgggtatcggtttggcaatcgccgataaatttgtagaggagggtgcgaaagtagttattactggtcgtcacgcggatgtaggtgaaaaagccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggcaattgcgagcgttgaacggactaccacggaggaatggcgtaaaatcctgtccgttaatctggatggtgtttttttcggcacccgtctgggcattcagcgcatgaaaaataaaggcttgggcgctagcatcatcaatatgagcgcgatcgcggggctcgtaggcgctccgactgcaggggcatacaacgcttccaagggggcggtacgtatcatgtcgaaaagcgcagcgctggattgcgcactgaaggactacgatgtgcgtgtcaacacagtacatccgggcgcgatcaagaccccacggaaggatcagctggaaggtgctgaggaagcaatgtcacagcgtacgctgacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 220 - protein, 252 aa, Artificial Sequence
  Engineered Variant of Kred from Lactobacillus kefir
MTDRLKHKVAIVTGGTMGIGLAIADKFVEEGAKVVITGRHADVGEKAAKSIGGTDVIRFVQHDASEEAGWTKLFDTTEEAFGPVTTLVNNAGIGAIASVERTTTEEWRKILSVNLDGVFFGTRLGIQRMKNKGLGASIINMSAIAGLVGAPTAGAYNASKGAVRIMSKSAALDCALKDYDVRVNTVHPGAIKTPRKDQLEGAEEAMSQRTLTPMGHIGEPNDIAWICVYLASDESKFATGAEFVVDGGWTAQ

SEQ ID NO: 221 - DNA, 756 bp, Artificial Sequence
  Engineered Variant of Kred from Lactobacillus kefir
atgaccgatcgtctgaagcataaagtagccatcgttaccggcgggacaatgggtatcggtttggcaatcgccgataaatttgtagaggagggtgcgaaagtagttattactggtcgtcacgcggatgtaggtgaaaaagccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggtaattgcgagcgttgaacggactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgctccgactgcaggggcatacaacgcttccaagggggcggtacgtatcatgtcgaaaagcgcagcgctggattgcgcactgaaggactacgatgtgcgtgtcaacacagtacatccgggcgcgatcaagaccccacggaaggatcagctggaaggttgggaggaaatggcttcacagcgtacgctgacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 222 - protein, 252 aa, Artificial Sequence
  Engineered Variant of Kred from Lactobacillus kefir
MTDRLKHKVAIVTGGTMGIGLAIADKFVEEGAKVVITGRHADVGEKAAKSIGGTDVIRFVQHDASEEAGWTKLFDTTEEAFGPVTTLVNNAGIGVIASVERTTTEEWRKILSVNLDGVFFGTRLGIQRMKNKGLGASIINMSSIMGLVGAPTAGAYNASKGAVRIMSKSAALDCALKDYDVRVNTVHPGAIKTPRKDQLEGWEEMASQRTLTPMGHIGEPNDIAWICVYLASDESKFATGAEFVVDGGWTAQ

SEQ ID NO: 223 - DNA, 756 bp, Artificial Sequence
  Engineered Variant of Kred from Lactobacillus kefir
atgaccgatcgtctgaagcataaagtagccatcgttaccggcgggacaatgggtatcggtttggcaatcgccgataaatttgtagaggagggtgcgaaagtagttattactggtcgtcacgcggatgtaggtgaaaaagccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggcaattgcgagcgttgaacggactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgctccgactgcaggggcatacaacgcttccaagggggcggtacgtatcatgtcgaaaagcgcagcgctggattgcgcactgaaggactacgatgtgcgtgtcaacacagtacatccgggcgcgatcaagaccccacggaaggatcagctggaaggtgctgaggaagcagcttcacagcgtacgctgacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 224 - protein, 252 aa, Artificial Sequence
  Engineered Variant of Kred from Lactobacillus kefir
MTDRLKHKVAIVTGGTMGIGLAIADKFVEEGAKVVITGRHADVGEKAAKSIGGTDVIRFVQHDASEEAGWTKLFDTTEEAFGPVTTLVNNAGIGAIASVERTTTEEWRKILSVNLDGVFFGTRLGIQRMKNKGLGASIINMSSIMGLVGAPTAGAYNASKGAVRIMSKSAALDCALKDYDVRVNTVHPGAIKTPRKDQLEGAEEAASQRTLTPMGHIGEPNDIAWICVYLASDESKFATGAEFVVDGGWTAQ

SEQ ID NO: 225 - DNA, 756 bp, Artificial Sequence
  Engineered Variant of Kred from Lactobacillus kefir
atgaccgatcgtctgaagcataaagtagccatcgttaccggcgggacaatgggtatcggtttggcaatcgccgataaatttgtagaggagggtgcgaaagtagttattactggtcgtcacgcggatgtaggtgaaaaagccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggtaattaagagcgttgaacggactaccacggaggaatggcgtaaaatcctgtccgttaatctggatggtgtttttttcggcacccgtctgggcattcagcgcatgaaaaataaaggcttgggcgctagcatcatcaatatgagcgcggcggcggggctcgtaggcgctccgactgcaggggcatacaacgcttccaagggggcggtacgtatcatgtcgaaaagcgcagcgctggattgcgcactgaaggactacgatgtgcgtgtcaacacagtacatccgggcgcgatcaagaccccacggaaggatcagctggaaggtgctgaggaagcaatgtcacagcgtacgctgacccctatgggccacattggcgaaccgaatgacatcgcatggatctgtgtgtacctggcatctgacgaatcgaaatttgcgacgggtgcagaatttgtggtcgacggcggggcaaccgcacag

SEQ ID NO: 226 - protein, 252 aa, Artificial Sequence
  Engineered Variant of Kred from Lactobacillus kefir
MTDRLKHKVAIVTGGTMGIGLAIADKFVEEGAKVVITGRHADVGEKAAKSIGGTDVIRFVQHDASEEAGWTKLFDTTEEAFGPVTTLVNNAGIGVIKSVERTTTEEWRKILSVNLDGVFFGTRLGIQRMKNKGLGASIINMSAAAGLVGAPTAGAYNASKGAVRIMSKSAALDCALKDYDVRVNTVHPGAIKTPRKDQLEGAEEAMSQRTLTPMGHIGEPNDIAWICVYLASDESKFATGAEFVVDGGATAQ

SEQ ID NO: 227 - DNA, 756 bp, Artificial Sequence
  Engineered Variant of Kred from Lactobacillus kefir
atgaccgatcgtctgaagcataaagtagccatcgttaccggcgggacaatgggtatcggtttggcaatcgccgataaatttgtagaggagggtgcgaaagtagttattactggtcgtcacgcggatgtaggtgaaaaagccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggttattaaaagcgttgaacggactaccacggaggaatggcgtaaaatcctgtccgttaatctggatggtgtttttttcggcacccgtctgggcattcagcgcatgaaaaataaaggcttgggcgctagcatcatcaatatgagcgcgatcgcggggctcgtaggcgctccgactgcaggggcatacaacgcttccaagggggcggtacgtatcatgtcgaaaagcgcagcgctggattgcgcactgaaggactacgatgtgcgtgtcaacacagtacatccgggcgcgatcaagaccccacggaaggatcagctggaaggttgggaggaaatgatgtcacagcgtacgctgacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 228 - protein, 252 aa, Artificial Sequence
  Engineered Variant of Kred from Lactobacillus kefir
MTDRLKHKVAIVTGGTMGIGLAIADKFVEEGAKVVITGRHADVGEKAAKSIGGTDVIRFVQHDASEEAGWTKLFDTTEEAFGPVTTLVNNAGIGVIKSVERTTTEEWRKILSVNLDGVFFGTRLGIQRMKNKGLGASIINMSAIAGLVGAPTAGAYNASKGAVRIMSKSAALDCALKDYDVRVNTVHPGAIKTPRKDQLEGWEEMMSQRTLTPMGHIGEPNDIAWICVYLASDESKFATGAEFVVDGGWTAQ

SEQ ID NO: 229 - DNA, 756 bp, Artificial Sequence
  Engineered Variant of Kred from Lactobacillus kefir
atgaccgatcgtctgaagcataaagtagccatcgttaccggcgggacaatgggtatcggtttggcaatcgccgataaatttgtagaggagggtgcgaaagtagttattactggtcgtcacgcggatgtaggtgaaaaagccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggcaattgcgagcgttgaacggactaccacggaggaatggcgtaaaatcctgtccgttaatctggatggtgtttttttcggcacccgtctgggcattcagcgcatgaaaaataaaggcttgggcgctagcatcatcaatatgagcgcgatcgcggggctcgtaggcgctccgactgcaggggcatacaacgcttccaagggggcggtacgtatcatgtcgaaaagcgcagcgctggattgcgcactgaaggactacgatgtgcgtgtcaacacagtacatccgggcgcgatcaagaccccacggaaggatcagctggaaggttgggaggaaatgatgtcacagcgtacgctgacccctatgggccacattggcgaaccgaatgacatcgcatggatctgtgtgtacctggcatctgacgaatcgaaatttgcgacgggtgcagaatttgtggtcgacggcggggcaaccgcacag

SEQ ID NO: 230 - protein, 252 aa, Artificial Sequence
  Engineered Variant of Kred from Lactobacillus kefir
MTDRLKHKVAIVTGGTMGIGLAIADKFVEEGAKVVITGRHADVGEKAAKSIGGTDVIRFVQHDASEEAGWTKLFDTTEEAFGPVTTLVNNAGIGAIASVERTTTEEWRKILSVNLDGVFFGTRLGIQRMKNKGLGASIINMSAIAGLVGAPTAGAYNASKGAVRIMSKSAALDCALKDYDVRVNTVHPGAIKTPRKDQLEGWEEMMSQRTLTPMGHIGEPNDIAWICVYLASDESKFATGAEFVVDGGATAQ

SEQ ID NO: 231 - DNA, 756 bp, Artificial Sequence
  Engineered Variant of Kred from Lactobacillus kefir
atgaccgatcgtctgaagcataaagtagccatcgttaccggcgggacaatgggtatcggtttggcaatcgccgataaatttgtagaggagggtgcgaaagtagttattactggtcgtcacgcggatgtaggtgaaaaagccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggtagccaagagcgttgaacggactaccacggaggaatggcgtaaaatcctgtccgttaatctggatggtgtttttttcggcacccgtctgggcattcagcgcatgaaaaataaaggcttgggcgctagcatcatcaatatgagctcgatcatggggctcgtaggcgctccgactgcaggggcatacaacgcttccaagggggcggtacgtatcatgtcgaaaagcgcagcgctggattgcgcactgaaggactacgatgtgcgtgtcaacacagtacatccgggcgcgatcaagaccccacggaaggatcagctggaaggttgggaggaaatggcttcacagcgtacgctgacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 232 - protein, 252 aa, Artificial Sequence
  Engineered Variant of Kred from Lactobacillus kefir
MTDRLKHKVAIVTGGTMGIGLAIADKFVEEGAKVVITGRHADVGEKAAKSIGGTDVIRFVQHDASEEAGWTKLFDTTEEAFGPVTTLVNNAGIGVAKSVERTTTEEWRKILSVNLDGVFFGTRLGIQRMKNKGLGASIINMSSIMGLVGAPTAGAYNASKGAVRIMSKSAALDCALKDYDVRVNTVHPGAIKTPRKDQLEGWEEMASQRTLTPMGHIGEPNDIAWICVYLASDESKFATGAEFVVDGGWTAQ

SEQ ID NO: 233 - DNA, 756 bp, Artificial Sequence
  Engineered Variant of Kred from Lactobacillus kefir
atgaccgatcgtctgaagcataaagtagccatcgttaccggcgggacaatgggtatcggtttggcaatcgccgataaatttgtagaggagggtgcgaaagtagttattactggtcgtcacgcggatgtaggtgaaaaagccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggtaattaagagcgttgaacggactaccacggaggaatggcgtaaaatcctgtccgttaatctggatggtgtttttttcggcacccgtctgggcattcagcgcatgaaaaataaaggcttgggcgctagcatcatcaatatgagctcggcgatggggctcgtaggcgctccgactgcaggggcatacaacgcttccaagggggcggtacgtatcatgtcgaaaagcgcagcgctggattgcgcactgaaggactacgatgtgcgtgtcaacacagtacatccgggcgcgatcaagaccccacggaaggatcagctggaaggtgctgaggaagcagcttcacagcgtacgctgacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 234 - protein, 252 aa, Artificial Sequence
  Engineered Variant of Kred from Lactobacillus kefir
MTDRLKHKVAIVTGGTMGIGLAIADKFVEEGAKVVITGRHADVGEKAAKSIGGTDVIRFVQHDASEEAGWTKLFDTTEEAFGPVTTLVNNAGIGVIKSVERTTTEEWRKILSVNLDGVFFGTRLGIQRMKNKGLGASIINMSSAMGLVGAPTAGAYNASKGAVRIMSKSAALDCALKDYDVRVNTVHPGAIKTPRKDQLEGAEEAASQRTLTPMGHIGEPNDIAWICVYLASDESKFATGAEFVVDGGWTAQ

SEQ ID NO: 235 - DNA, 756 bp, Artificial Sequence
  Engineered Variant of Kred from Lactobacillus kefir
atgaccgatcgtctgaagcataaagtagccatcgttaccggcgggacaatgggtatcggtttggcaatcgccgataaatttgtagaggagggtgcgaaagtagttattactggtcgtcacgcggatgtaggtgaaaaagccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggcagccaagagcgttgaacggactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgctccgactgcaggggcatacaacgcttccaagggggcggtacgtatcatgtcgaaaagcgcagcgctggattgcgcactgaaggactacgatgtgcgtgtcaacacagtacatccgggcgcgatcaagaccccacggaaggatcagctggaaggttgggaggaagcagcttcacagcgtacggcgacccctatgggccacattggcgaaccgaatgacatcgcatggatctgtgtgtacctggcatctgacgaatcgaaatttgcgacgggtgcagaatttgtggtcgacggcggggcaaccgcacag

SEQ ID NO: 236 - protein, 252 aa, Artificial Sequence
  Engineered Variant of Kred from Lactobacillus kefir
MTDRLKHKVAIVTGGTMGIGLAIADKFVEEGAKVVITGRHADVGEKAAKSIGGTDVIRFVQHDASEEAGWTKLFDTTEEAFGPVTTLVNNAGIGAAKSVERTTTEEWRKILSVNLDGVFFGTRLGIQRMKNKGLGASIINMSSIMGLVGAPTAGAYNASKGAVRIMSKSAALDCALKDYDVRVNTVHPGAIKTPRKDQLEGWEEAASQRTATPMGHIGEPNDIAWICVYLASDESKFATGAEFVVDGGATAQ

SEQ ID NO: 237 - DNA, 756 bp, Artificial Sequence
  Engineered Variant of Kred from Lactobacillus kefir
atgaccgatcgtctgaagcataaagtagccatcgttaccggcgggacaatgggtatcggtttggcaatcgccgataaatttgtagaggagggtgcgaaagtagttattactggtcgtcacgcggatgtaggtgaaaaagccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggcaattaagagcgttgaacggactaccacggaggaatggcgtaaaatcctgtccgttaatctggatggtgtttttttcggcacccgtctgggcattcagcgcatgaaaaataaaggcttgggcgctagcatcatcaatatgagctcgatcatggggctcgtaggcgctccgactgcaggggcatacaacgcttccaagggggcggtacgtatcatgtcgaaaagcgcagcgctggattgcgcactgaaggactacgatgtgcgtgtcaacacagtacatccgggcgcgatcaagaccccacggaaggatcagctggaaggttgggaggaaatggcttcacagcgtacgctgacccctatgggccacattggcgaaccgaatgacatcgcatggatctgtgtgtacctggcatctgacgaatcgaaatttgcgacgggtgcagaatttgtggtcgacggcggggcaaccgcacag

SEQ ID NO: 238 - protein, 252 aa, Artificial Sequence
  Engineered Variant of Kred from Lactobacillus kefir
MTDRLKHKVAIVTGGTMGIGLAIADKFVEEGAKVVITGRHADVGEKAAKSIGGTDVIRFVQHDASEEAGWTKLFDTTEEAFGPVTTLVNNAGIGAIKSVERTTTEEWRKILSVNLDGVFFGTRLGIQRMKNKGLGASIINMSSIMGLVGAPTAGAYNASKGAVRIMSKSAALDCALKDYDVRVNTVHPGAIKTPRKDQLEGWEEMASQRTLTPMGHIGEPNDIAWICVYLASDESKFATGAEFVVDGGATAQ

SEQ ID NO: 239 - DNA, 756 bp, Artificial Sequence
  Engineered Variant of Kred from Lactobacillus kefir
atgaccgatcgtctgaagcataaagtagccatcgttaccggcgggacaatgggtatcggtttggcaatcgccgataaatttgtagaggagggtgcgaaagtagttattactggtcgtcacgcggatgtaggtgaaaaagccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggttattaaaagcgttgaacggactaccacggaggaatggcgtaaaatcctgtccgttaatctggatggtgtttttttcggcacccgtctgggcattcagcgcatgaaaaataaaggcttgggcgctagcatcatcaatatgagctcggcggcggggctcgtaggcgctccgactgcaggggcatacaacgcttccaagggggcggtacgtatcatgtcgaaaagcgcagcgctggattgcgcactgaaggactacgatgtgcgtgtcaacacagtacatccgggcgcgatcaagaccccacggaaggatcagctggaaggttgggaggaagcagcttcacagcgtacgctgacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 240 - protein, 252 aa, Artificial Sequence
  Engineered Variant of Kred from Lactobacillus kefir
MTDRLKHKVAIVTGGTMGIGLAIADKFVEEGAKVVITGRHADVGEKAAKSIGGTDVIRFVQHDASEEAGWTKLFDTTEEAFGPVTTLVNNAGIGVIKSVERTTTEEWRKILSVNLDGVFFGTRLGIQRMKNKGLGASIINMSSAAGLVGAPTAGAYNASKGAVRIMSKSAALDCALKDYDVRVNTVHPGAIKTPRKDQLEGWEEAASQRTLTPMGHIGEPNDIAWICVYLASDESKFATGAEFVVDGGWTAQ

SEQ ID NO: 241 - DNA, 756 bp, Artificial Sequence
  Engineered Variant of Kred from Lactobacillus kefir
atgaccgatcgtctgaagcataaagtagccatcgttaccggcgggacaatgggtatcggtttggcaatcgccgataaatttgtagaggagggtgcgaaagtagttattactggtcgtcacgcggatgtaggtgaaaaagccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggttattaaaagcgttgaacggactaccacggaggaatggcgtaaaatcctgtccgttaatctggatggtgtttttttcggcacccgtctgggcattcagcgcatgaaaaataaaggcttgggcgctagcatcatcaatatgagctcgatcgcggggctcgtaggcgctccgactgcaggggcatacaacgcttccaagggggcggtacgtatcatgtcgaaaagcgcagcgctggattgcgcactgaaggactacgatgtgcgtgtcaacacagtacatccgggcgcgatcaagaccccacggaaggatcagctggaaggttgggaggaaatggcttcacagcgtacgctgacccctatgggccacattggcgaaccgaatgacatcgcatggatctgtgtgtacctggcatctgacgaatcgaaatttgcgacgggtgcagaatttgtggtcgacggcggggcaaccgcacag

SEQ ID NO: 242 - protein, 252 aa, Artificial Sequence
  Engineered Variant of Kred from Lactobacillus kefir
MTDRLKHKVAIVTGGTMGIGLAIADKFVEEGAKVVITGRHADVGEKAAKSIGGTDVIRFVQHDASEEAGWTKLFDTTEEAFGPVTTLVNNAGIGVIKSVERTTTEEWRKILSVNLDGVFFGTRLGIQRMKNKGLGASIINMSSIAGLVGAPTAGAYNASKGAVRIMSKSAALDCALKDYDVRVNTVHPGAIKTPRKDQLEGWEEMASQRTLTPMGHIGEPNDIAWICVYLASDESKFATGAEFVVDGGATAQ

SEQ ID NO: 243 - DNA, 756 bp, Artificial Sequence
  Engineered Variant of Kred from Lactobacillus kefir
atgaccgatcgtctgaagcataaagtagccatcgttaccggcgggacaatgggtatcggtttggcaatcgccgataaatttgtagaggagggtgcgaaagtagttattactggtcgtcacgcggatgtaggtgaaaaagccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggttattaaaagcgttgaacggactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgctccgactgcaggggcatacaacgcttccaagggggcggtacgtatcatgtcgaaaagcgcagcgctggattgcgcactgaaggactacgatgtgcgtgtcaacacagtacatccgggcgcgatcaagaccccacggaaggatcagctggaaggttgggaggaaatgatgtcacagcgtacgctgacccctatgggccacattggcgaaccgaatgacatcgcatggatctgtgtgtacctggcatctgacgaatcgaaatttgcgacgggtgcagaatttgtggtcgacggcggggcaaccgcacag

SEQ ID NO: 244 - protein, 252 aa, Artificial Sequence
  Engineered Variant of Kred from Lactobacillus kefir
MTDRLKHKVAIVTGGTMGIGLAIADKFVEEGAKVVITGRHADVGEKAAKSIGGTDVIRFVQHDASEEAGWTKLFDTTEEAFGPVTTLVNNAGIGVIKSVERTTTEEWRKILSVNLDGVFFGTRLGIQRMKNKGLGASIINMSSIMGLVGAPTAGAYNASKGAVRIMSKSAALDCALKDYDVRVNTVHPGAIKTPRKDQLEGWEEMMSQRTLTPMGHIGEPNDIAWICVYLASDESKFATGAEFVVDGGATAQ

SEQ ID NO: 245 - DNA, 756 bp, Artificial Sequence
  Engineered Variant of Kred from Lactobacillus kefir
atgaccgatcgtctgaagcataaagtagccatcgttaccggcgggacaatgggtatcggtttggcaatcgccgataaatttgtagaggagggtgcgaaagtagttattactggtcgtcacgcggatgtaggtgaaaaagccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggttattaaaagcgttgaacggactaccacggaggaatggcgtaaaatcctgtccgttaatctggatggtgtttttttcggcacccgtctgggcattcagcgcatgaaaaataaaggcttgggcgctagcatcatcaatatgagctcggcgatggggctcgtaggcgctccgactgcaggggcatacaacgcttccaagggggcggtacgtatcatgtcgaaaagcgcagcgctggattgcgcactgaaggactacgatgtgcgtgtcaacacagtacatccgggcgcgatcaagaccccacggaaggatcagctggaaggttgggaggaaatgatgtcacagcgtacgctgacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 246 - protein, 252 aa, Artificial Sequence
  Engineered Variant of Kred from Lactobacillus kefir
MTDRLKHKVAIVTGGTMGIGLAIADKFVEEGAKVVITGRHADVGEKAAKSIGGTDVIRFVQHDASEEAGWTKLFDTTEEAFGPVTTLVNNAGIGVIKSVERTTTEEWRKILSVNLDGVFFGTRLGIQRMKNKGLGASIINMSSAMGLVGAPTAGAYNASKGAVRIMSKSAALDCALKDYDVRVNTVHPGAIKTPRKDQLEGWEEMMSQRTLTPMGHIGEPNDIAWICVYLASDESKFATGAEFVVDGGWTAQ

SEQ ID NO: 247 - DNA, 756 bp, Artificial Sequence
  Engineered Variant of Kred from Lactobacillus kefir
atgaccgatcgtctgaagcataaagtagccatcgttaccggcgggacaatgggtatcggtttggcaatcgccgataaatttgtagaggagggtgcgaaagtagttattactggtcgtcacgcggatgtaggtgaaaaagccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggttattaaaagcgttgaacggactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgctccgactgcaggggcatacaacgcttccaagggggcggtacgtatcatgtcgaaaagcgcagcgctggattgcgcactgaaggactacgatgtgcgtgtcaacacagtacatccgggcgcgatcaagaccccacggaaggatcagctggaaggtgctgaggaaatggcttcacagcgtacgctgacccctatgggccacattggcgaaccgaatgacatcgcatggatctgtgtgtacctggcatctgacgaatcgaaatttgcgacgggtgcagaatttgtggtcgacggcggggcaaccgcacag

SEQ ID NO: 248 - protein, 252 aa, Artificial Sequence
  Engineered Variant of Kred from Lactobacillus kefir
MTDRLKHKVAIVTGGTMGIGLAIADKFVEEGAKVVITGRHADVGEKAAKSIGGTDVIRFVQHDASEEAGWTKLFDTTEEAFGPVTTLVNNAGIGVIKSVERTTTEEWRKILSVNLDGVFFGTRLGIQRMKNKGLGASIINMSSIMGLVGAPTAGAYNASKGAVRIMSKSAALDCALKDYDVRVNTVHPGAIKTPRKDQLEGAEEMASQRTLTPMGHIGEPNDIAWICVYLASDESKFATGAEFVVDGGATAQ

SEQ ID NO: 249 - DNA, 756 bp, Artificial Sequence
  Engineered Variant of Kred from Lactobacillus kefir
atgaccgatcgtctgaagcataaagtagccatcgttaccggcgggacaatgggtatcggtttggcaatcgccgataaatttgtagaggagggtgcgaaagtagttattactggtcgtcacgcggatgtaggtgaaaaagccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggcaattaagagcgttgaacggactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgctccgactgcaggggcatacaacgcttccaagggggcggtacgtatcatgtcgaaaagcgcagcgctggattgcgcactgaaggactacgatgtgcgtgtcaacacagtacatccgggcgcgatcaagaccccacggaaggatcagctggaaggttgggaggaaatggcttcacagcgtacgctgacccctatgggccacattggcgaaccgaatgacatcgcatggatctgtgtgtacctggcatctgacgaatcgaaatttgcgacgggtgcagaatttgtggtcgacggcggggcaaccgcacag

SEQ ID NO: 250 - protein, 252 aa, Artificial Sequence; identical to SEQ ID NO: 238
  Engineered Variant of Kred from Lactobacillus kefir

SEQ ID NO: 251 - DNA, 756 bp, Artificial Sequence
  Engineered Variant of Kred from Lactobacillus kefir
atgaccgatcgtctgaagcataaagtagccatcgttaccggcgggacaatgggtatcggtttggcaatcgccgataaatttgtagaggagggtgcgaaagtagttattactggtcgtcacgcggatgtaggtgaaaaagccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggttattaaaagcgttgaacggactaccacggaggaatggcgtaaagttctgtccgttaatctggatggtgtttttttcggcacccgtctgggcattcagcgcatgaaaaataaaggcttgggcgctagcatcatcaatatgagcagtattatggggctcgtaggcgatccgactctgggggcatacaacgcttccaagggggcggtacgtatcatgtcgaaaagcgcagcgctggattgcgcactgaaggacatggatgtgcgtgtcaacacagtacatccgggcgcgatcaagaccgaacggaaggatcagctggaaggttgggaggaaatgatgtcacagcgtacgctgacccctatgggccacattggcgaaccgaatgacatcgcatggatctgtgtgtacctggcgtctgacgaatcgaaatttgcgacgggtgcagaatttgtggtcgacggcgggtggaccgcacag

SEQ ID NO: 252 - protein, 252 aa, Artificial Sequence
  Engineered Variant of Kred from Lactobacillus kefir
MTDRLKHKVAIVTGGTMGIGLAIADKFVEEGAKVVITGRHADVGEKAAKSIGGTDVIRFVQHDASEEAGWTKLFDTTEEAFGPVTTLVNNAGIGVIKSVERTTTEEWRKVLSVNLDGVFFGTRLGIQRMKNKGLGASIINMSSIMGLVGDPTLGAYNASKGAVRIMSKSAALDCALKDMDVRVNTVHPGAIKTERKDQLEGWEEMMSQRTLTPMGHIGEPNDIAWICVYLASDESKFATGAEFVVDGGWTAQ

SEQ ID NO: 253 - DNA, 756 bp, Artificial Sequence
  Engineered Variant of Kred from Lactobacillus kefir
atgaccgatcgtctgaagcataaagtagccatcgttaccggcgggacaatgggtatcggtttggcaatcgccgataaatttgtagaggagggtgcgaaagtagttattactggtcgtcacgcggatgtaggtgaaaaagccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggttattaaaagcgttgaacggactaccacggaggaatggcgtaaagtgctgtccgttaatctggatggtgtttttttcggcacccgtctgggcattcagcgcatgaaaaataaaggcttgggcgctagcatcatcaatatgagcagtattatggggctcgtaggcgatccgactctgggggcatacaacgcttccaagggggcggtacgtatcatgtcgaaaagcgcagcgctggattgcgcactgaaggactacgatgtgcgtgtcaacacagtacatccgggcgcgatcaagaccccacggaaggatcagctggaaggttgggaggaaatgatgtcacagcgtacgctgacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 254 - protein, 252 aa, Artificial Sequence
  Engineered Variant of Kred from Lactobacillus kefir
MTDRLKHKVAIVTGGTMGIGLAIADKFVEEGAKVVITGRHADVGEKAAKSIGGTDVIRFVQHDASEEAGWTKLFDTTEEAFGPVTTLVNNAGIGVIKSVERTTTEEWRKVLSVNLDGVFFGTRLGIQRMKNKGLGASIINMSSIMGLVGDPTLGAYNASKGAVRIMSKSAALDCALKDYDVRVNTVHPGAIKTPRKDQLEGWEEMMSQRTLTPMGHIGEPNDIAWICVYLASDESKFATGAEFVVDGGWTAQ

SEQ ID NO: 255 - DNA, 756 bp, Artificial Sequence
  Engineered Variant of Kred from Lactobacillus kefir
atgaccgatcgtctgaagcataaagtagccatcgttaccggcgggacaatgggtatcggtttggcaatcgccgataaatttgtagaggagggtgcgaaagtagttattactggtcgtcacgcggatgtaggtgaaaaagccgccaaatcaatcggcggcactgatgttattcgctttgtccagcacgatgcgtccgaagaagcaggctggacgaagctgttcgacaccaccgaggaggcattcggcccggttacgaccctggtgaacaatgcagggattggggttattaaaagcgttgaacgtactcgcacggaggaatggcgtaaaatcctgtccgttaatctggatggtgtttttttcggcacccgtctgggcattcagcgcatgaaaaataaaggcttgggcgctagcatcatcaatatgagcagtattatggggattgtaggcgatccgactctgggggcatacaacgcttccaagggggcggtacgtatcatgtcgaaaagcgcagcgctggattgcgcactgaaggactacgatgtgcgtgtcaacacagtacatccgggcgcgatcaagaccccacggaaggatcagctggaaggttgggaggaaatgatgtcacagcgtacgctgacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 256 - protein, 252 aa, Artificial Sequence
  Engineered Variant of Kred from Lactobacillus kefir
MTDRLKHKVAIVTGGTMGIGLAIADKFVEEGAKVVITGRHADVGEKAAKSIGGTDVIRFVQHDASEEAGWTKLFDTTEEAFGPVTTLVNNAGIGVIKSVERTRTEEWRKILSVNLDGVFFGTRLGIQRMKNKGLGASIINMSSIMGIVGDPTLGAYNASKGAVRIMSKSAALDCALKDYDVRVNTVHPGAIKTPRKDQLEGWEEMMSQRTLTPMGHIGEPNDIAWICVYLASDESKFATGAEFVVDGGWTAQ

SEQ ID NO: 257 - DNA, 756 bp, Artificial Sequence; identical to SEQ ID NO: 253
  Engineered Variant of Kred from Lactobacillus kefir

SEQ ID NO: 258 - protein, 252 aa, Artificial Sequence; identical to SEQ ID NO: 254
  Engineered Variant of Kred from Lactobacillus kefir

SEQ ID NO: 259 - DNA, 756 bp, Artificial Sequence
  Engineered Variant of Kred from Lactobacillus kefir
atgaccgatcgtctgaagcagaaagtagccatcgttaccggcgggacaatgggtatcggtttggcaatcgccgataaatttgtagaggagggtgcgaaagtagttattactggtcgtcacgcggatgtaggtgaaaaagccgccaaatcaatcggcggcactgatgttattcgctttgtccagcacgatgcgtccgaagaagcaggctggacgaagctgttcgacaccaccgaggaggcattcggcccggttacgaccctggtgaacaatgcagggattggggttattaaaagcgttgaacggactaccacggaggaatggcgtaaaatcctgtccgttaatctggatggtgtttttttcggcacccgtctgggcattcagcgcatgaaaaataaaggcttgggcgctagcatcatcaatatgagcagtattatggggattgtaggcgatccgactctgggggcatacaacgcttccaagggggcggtacgtatcatgtcgaaaagcgcagcgctggattgcgcactgaaggactacgatgtgcgtgtcaacacagtacatccgggcgcgatcaagaccccacggaaggatcagctggaaggttgggaggaaatgatgtcacagcgtacgctgacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 260 - protein, 252 aa, Artificial Sequence
  Engineered Variant of Kred from Lactobacillus kefir
MTDRLKQKVAIVTGGTMGIGLAIADKFVEEGAKVVITGRHADVGEKAAKSIGGTDVIRFVQHDASEEAGWTKLFDTTEEAFGPVTTLVNNAGIGVIKSVERTTTEEWRKILSVNLDGVFFGTRLGIQRMKNKGLGASIINMSSIMGIVGDPTLGAYNASKGAVRIMSKSAALDCALKDYDVRVNTVHPGAIKTPRKDQLEGWEEMMSQRTLTPMGHIGEPNDIAWICVYLASDESKFATGAEFVVDGGWTAQ

SEQ ID NO: 261 - DNA, 756 bp, Artificial Sequence
  Engineered Variant of Kred from Lactobacillus kefir
atgaccgatcgtctgaagcataaagtagccatcgttaccggcgggacaatgggtatcggtttggcaatcgccgataaatttgtagaggagggtgcgaaagtagttattactggtcgtcacgcggatgtaggtgaaaaagccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggttattaaaagcgttgaacggactaccacggaggaatggcgtaaaatcctgtccgttaatctggatggtgtttttttcggcacccgtctgggcattcagcgcatgaaaaataaaggcttgggcgctagcatcatcaatatgagcagtattatggggctcgtaggcgatccgactctgggggcatacaacgcttccaagggggcggtacgtatcatgtcgaaaagcgcagcgctggattgcgcactgaaggactacgatgtgcgtgtcaacacagtacatccgggcgcgatcaagaccccacggaaggatcagctggaaggttgggaggaaatgatgtcacagcgtacgctgacccctatgggccacattggcgaaccgaatgacatcgcatggatctgtgtgtacctggcatctgacgaatcgaaatttgcgacgggtgcagaatttgtggtcgacggcgggtacaccgcacag

SEQ ID NO: 262 - protein, 252 aa, Artificial Sequence
  Engineered Variant of Kred from Lactobacillus kefir
MTDRLKHKVAIVTGGTMGIGLAIADKFVEEGAKVVITGRHADVGEKAAKSIGGTDVIRFVQHDASEEAGWTKLFDTTEEAFGPVTTLVNNAGIGVIKSVERTTTEEWRKILSVNLDGVFFGTRLGIQRMKNKGLGASIINMSSIMGLVGDPTLGAYNASKGAVRIMSKSAALDCALKDYDVRVNTVHPGAIKTPRKDQLEGWEEMMSQRTLTPMGHIGEPNDIAWICVYLASDESKFATGAEFVVDGGYTAQ

SEQ ID NO: 263 - DNA, 756 bp, Artificial Sequence
  Engineered Variant of Kred from Lactobacillus kefir
atgaccgatcgtctgaagcataaagtagccatcgttaccggcgggacaatgggtatcggtttggcaatcgccgataaatttgtagaggagggtgcgaaagtagttattactggtcgtcacgcggatgtaggtgaaaaagccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggttattaaaagcgttgaacggactaccacggaggaatggcgtaaaatcctgtccgttaatctggatggtgtttttttcggcacccgtctgggcattcagcgcatgaaaaataaaggcttgggcgctagcatcatcaatatgagcagtattatggggattgtaggcgatccgactctgggggcatacaacgcttccaagggggcggtacgtatcatgtcgaaaagcgcagcgctggattgcgcactgaaggactacgatgtgcgtgtcaacacagtacatccgggcgcgatcaagaccccacggaaggatcagctggaaggttgggaggaaatgatgtcacagcgtacgctgacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 264 - protein, 252 aa, Artificial Sequence
  Engineered Variant of Kred from Lactobacillus kefir
MTDRLKHKVAIVTGGTMGIGLAIADKFVEEGAKVVITGRHADVGEKAAKSIGGTDVIRFVQHDASEEAGWTKLFDTTEEAFGPVTTLVNNAGIGVIKSVERTTTEEWRKILSVNLDGVFFGTRLGIQRMKNKGLGASIINMSSIMGIVGDPTLGAYNASKGAVRIMSKSAALDCALKDYDVRVNTVHPGAIKTPRKDQLEGWEEMMSQRTLTPMGHIGEPNDIAWICVYLASDESKFATGAEFVVDGGWTAQ

SEQ ID NO: 265 - DNA, 756 bp, Artificial Sequence
  Engineered Variant of Kred from Lactobacillus kefir
atgaccgatcgtctgaagcacaaagtagccatcatcaccggcgggacaatgggtatcggtttggcaatcgccgataaatttgtagaggagggtgcgaaagtagttattactggtcgtcacgcggatgtaggtgaaaaagccgccaaatcaatcggcggcactgatgttattcgctttgtccagcacgatgcgagcgaagaagcaggctggacgagtctgttcgacaccaccgaggaggcattcggcccggttacgaccctggtgaacaatgcagggattggggtaattaagagcgttgaacggactaccacggaggaatggcgtaaagttctgtccgttaatctggatggtgtttttttcggcacccgtctgggcattcagcgcatgaaaaataaaggcttgggcgctagcatcatcaatatgagcagtattatggggattgtaggcgctccgatggcaggggcatacaacgcttccaagggggcggtacgtatcatgtcgaaaagcgcagcgctggattgcgcactgaaggactacgatgtgcgtgtcaacacagtacatccgggcgcgatcaagaccccacggaaggatcagctggaaggttgggagcaggcaatgtcacagcgtacggcgacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 266 - protein, 252 aa, Artificial Sequence
  Engineered Variant of Kred from Lactobacillus kefir
MTDRLKHKVAIITGGTMGIGLAIADKFVEEGAKVVITGRHADVGEKAAKSIGGTDVIRFVQHDASEEAGWTSLFDTTEEAFGPVTTLVNNAGIGVIKSVERTTTEEWRKVLSVNLDGVFFGTRLGIQRMKNKGLGASIINMSSIMGIVGAPMAGAYNASKGAVRIMSKSAALDCALKDYDVRVNTVHPGAIKTPRKDQLEGWEQAMSQRTATPMGHIGEPNDIAWICVYLASDESKFATGAEFVVDGGWTAQ

SEQ ID NO: 267 - DNA, 756 bp, Artificial Sequence
  Engineered Variant of Kred from Lactobacillus kefir
atgaccgaccgtctgaagcacaaagtagccatcatcaccggcgggacaatgggtatcggtttggcaatcgccgataaatttgtagaggagggtgcgaaagtagttattactggtcgtcacgcggatgtaggtgaaaaagccgccaaatcaatcggcggcactgatgttattcgctttgtccagcacgatgcgagcgaagaagcaggctggacgagtctgttcgacaccaccgaggaggcattcggcccggttacgaccctggtgaacaatgcagggattggggtaattaagagcgttgaatatactcagacggaggaatggcgtaaagttctgtccgttaatctggatggtgtttttttcggcacccgtctgggcattcagcgcatgaaaaataaaggcttgggcgctagcatcatcaatatgagcagtattatggggctggtaggcgctccgatggcaggggcatacaacgcttccaagggggcggtacgtatcatgtcgaaaagcgcagcgctggattgcgcactgaaggactacgatgtgcgtgtcaacacagtacatccgggcgcgatcaagaccccacggaaggatcagctggaaggttgggaggaagcaatgtcacagcgtacggcgacccctatgggccacattggcgaaccgaatgacatcgcatggatctgtgtgtacctggcatctgacgaatcgaaatttgcgacgggtgcagaatttgtggtcgacggcgggtacaccgcacag

SEQ ID NO: 268 - protein, 252 aa, Artificial Sequence
  Engineered Variant of Kred from Lactobacillus kefir
MTDRLKHKVAIITGGTMGIGLAIADKFVEEGAKVVITGRHADVGEKAAKSIGGTDVIRFVQHDASEEAGWTSLFDTTEEAFGPVTTLVNNAGIGVIKSVEYTQTEEWRKVLSVNLDGVFFGTRLGIQRMKNKGLGASIINMSSIMGLVGAPMAGAYNASKGAVRIMSKSAALDCALKDYDVRVNTVHPGAIKTPRKDQLEGWEEAMSQRTATPMGHIGEPNDIAWICVYLASDESKFATGAEFVVDGGYTAQ

SEQ ID NO: 269 - DNA, 756 bp, Artificial Sequence
  Engineered Variant of Kred from Lactobacillus kefir
atgaccgatcgtctgaagcacaaagtagccatcgtcaccggcgggacaatgggtatcggtttggcaatcgccgataaatttgtagaggagggtgcgaaagtagttattactggtcgtcacgcggatgtaggtctgaaagccgccaaatcaatcggtggcagtgatgttattcgctttgtccagcacgatgcgtccgaagaagcaggctggacgagtctgttcgacaccaccgaggaggcattcggcccggttacgaccctggtgaacaatgcagggattggggtaattaagagcgttgaacggactaccacggaggaatggcgtaaagttctgtccgttaatctggatggtgtttttttcggcacccgtctgggcattcagcgcatgaaaaataaaggcttgggcgctagcatcatcaatatgagcagtattatggggctggtaggcgctccgatggcaggggcatacaacgcttccaagggggcggtacgtatcatgtcgaaaagcgcagcgctggattgcgcactgaaggactacgatgtgcgtgtcaacacagtacatccgggcgcgatcaagaccgagcggaaggatcagctggaaggttgggagcaggcaatgtcacagcgtacggcgacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 270 - protein, 252 aa, Artificial Sequence
  Engineered Variant of Kred from Lactobacillus kefir
MTDRLKHKVAIVTGGTMGIGLAIADKFVEEGAKVVITGRHADVGLKAAKSIGGSDVIRFVQHDASEEAGWTSLFDTTEEAFGPVTTLVNNAGIGVIKSVERTTTEEWRKVLSVNLDGVFFGTRLGIQRMKNKGLGASIINMSSIMGLVGAPMAGAYNASKGAVRIMSKSAALDCALKDYDVRVNTVHPGAIKTERKDQLEGWEQAMSQRTATPMGHIGEPNDIAWICVYLASDESKFATGAEFVVDGGWTAQ

SEQ ID NO: 271 - DNA, 756 bp, Artificial Sequence
  Engineered Variant of Kred from Lactobacillus kefir
atgaccgaccgtctgaagcacaaagtagccatcattaccggcgggacaatgggtatcggtttggcaatcgccgataaatttgtagaggagggtgcgaaagtagttattactggtcgtcacgcggatgtaggtgaaaaagccgccaaatcaatcggtggcagtgatgttattcgctttgtccagcacgatgcgtcggaagaagcaggctggacgacgctgttcgacaccaccgaggaggcattcggcccggttacgaccctggtgaacaatgcagggattggggttattaaaagcgttgaacggactaccacggaggaatggcgtaaagttctgtccgttaatctggatggtgtttttttcggcacccgtctgggcattcagcgcatgaaaaataaaggcttgggcgctagcatcatcaatatgagcagtattatggggctcgtaggcgatccgatgctgggggcatacaacgcttccaagggggcggtacgtatcatgtcgaaaagcgcagcgctggattgcgcactgaaggactacgatgtgcgtgtcaacacagtacatccgggcgcgatcaagaccgaacggaaggatcagctggaaggttgggaggagatgatgtcacagcgtacgctgacccctatgggccacattggcgaaccgaatgacatcgcatggatctgtgtgtacctggcgtctgacgaatcgaaatttgcgacgggtgcagaatttgtggtcgacggcgggtacaccgcacag

SEQ ID NO: 272 - protein, 252 aa, Artificial Sequence
  Engineered Variant of Kred from Lactobacillus kefir
MTDRLKHKVAIITGGTMGIGLAIADKFVEEGAKVVITGRHADVGEKAAKSIGGSDVIRFVQHDASEEAGWTTLFDTTEEAFGPVTTLVNNAGIGVIKSVERTTTEEWRKVLSVNLDGVFFGTRLGIQRMKNKGLGASIINMSSIMGLVGDPMLGAYNASKGAVRIMSKSAALDCALKDYDVRVNTVHPGAIKTERKDQLEGWEEMMSQRTLTPMGHIGEPNDIAWICVYLASDESKFATGAEFVVDGGYTAQ

SEQ ID NO: 273 - DNA, 756 bp, Artificial Sequence
  Engineered Variant of Kred from Lactobacillus kefir
atgaccgaccgtctgaagcacaaagtagccatcgttaccggcgggacaatgggtatcggtttggcaatcgccgataaatttgtagaggagggtgcgaaagtagttattactggtcgtcacgcggatgtaggtgaaaaagccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggttattaaaagcgttgaacggactaccacggaggaatggcgtaaagttctgtccgttaatctggatggtgtttttttcggcacccgtctgggcattcagcgcatgaaaaataaaggcttgggcgctagcatcatcaatatgagcagtattatggggctcgtaggcgatccgacgctgggggcatacaacgcttccaagggggcggtacgtatcatgtcgaaaagcgcagcgctggattgcgcactgaaggacatggatgtgcgtgtcaacacagtacatccgggcgcgatcaagaccgaacggaaggatcagctggaaggttgggaggaaatgatgtcacagcgtacgctgacccctatgggccacattggcgaaccgaatgacatcgcatggatctgtgtgtacctggcgtctgacgaatcgaaatttgcgacgggtgcagaatttgtggtcgacggcgggtacaccgcacag

SEQ ID NO: 274 - protein, 252 aa, Artificial Sequence
  Engineered Variant of Kred from Lactobacillus kefir
MTDRLKHKVAIVTGGTMGIGLAIADKFVEEGAKVVITGRHADVGEKAAKSIGGTDVIRFVQHDASEEAGWTKLFDTTEEAFGPVTTLVNNAGIGVIKSVERTTTEEWRKVLSVNLDGVFFGTRLGIQRMKNKGLGASIINMSSIMGLVGDPTLGAYNASKGAVRIMSKSAALDCALKDMDVRVNTVHPGAIKTERKDQLEGWEEMMSQRTLTPMGHIGEPNDIAWICVYLASDESKFATGAEFVVDGGYTAQ

SEQ ID NO: 275 - DNA, 756 bp, Artificial Sequence
  Engineered Variant of Kred from Lactobacillus kefir
atgaccgaccgtctgaagcagaaagtagccatcattaccggcgggacaatgggtatcggtttggcaatcgccgataaatttgtagaggagggtgcgaaagtagttattactggtcgtcacgcggatgtaggtgaaaaagccgccaaatcaatcggtggcagtgatgttattcgctttgtccagcacgatgcgtccgaagaagcaggctggacgaaactgttcgacaccaccgaggaggcattcggcccggttacgaccctggtgaacaatgcagggattggggttattaaaagcgttgaacggactaccacggaggaatggcgtaaagttctgtccgttaatctggatggtgtttttttcggcacccgtctgggcattcagcgcatgaaaaataaaggcttgggcgctagcatcatcaatatgagcagtattatggggctggtaggcgatccgacgctgggggcatacaacgcttccaagggggcggtacgtatcatgtcgaaaagcgcagcgctggattgcgcactgaaggactacgatgtgcgtgtcaacacagtacatccgggcgcgatcaagaccgaacggaaggatcagctggaaggttgggaggaaatgatgtcacagcgtacgctgacccctatgggccacattggcgaaccgaatgacatcgcatggatctgtgtgtacctggcgtctgacgaatcgaaatttgcgacgggtgcagaatttgtggtcgacggcgggtacaccgcacag

SEQ ID NO: 276 - protein, 252 aa, Artificial Sequence
  Engineered Variant of Kred from Lactobacillus kefir
MTDRLKQKVAIITGGTMGIGLAIADKFVEEGAKVVITGRHADVGEKAAKSIGGSDVIRFVQHDASEEAGWTKLFDTTEEAFGPVTTLVNNAGIGVIKSVERTTTEEWRKVLSVNLDGVFFGTRLGIQRMKNKGLGASIINMSSIMGLVGDPTLGAYNASKGAVRIMSKSAALDCALKDYDVRVNTVHPGAIKTERKDQLEGWEEMMSQRTLTPMGHIGEPNDIAWICVYLASDESKFATGAEFVVDGGYTAQ

SEQ ID NO: 277 - DNA, 756 bp, Artificial Sequence
  Engineered Variant of Kred from Lactobacillus kefir
atgaccgatcgtctgaagcacaaagtagccatcgttaccggcgggacaatgggtatcggtttggcaatcgccgataaatttgtagaggagggtgcgaaagtagttattactggtcgtcacgcggatgtaggtgaaaaagccgccaaatcaatcggtggcactgatgttattcgctttgtccagcacgatgcgtcggaagaagcaggctggacgtcgctgttcgacaccaccgaggaggcattcggcccggttacgaccctggtgaacaatgcagggattggggttattaaaagcgttgaacggactaccacggaggaatggcgtaaagttctgtccgttaatctggatggtgtttttttcggcacccgtctgggcattcagcgcatgaaaaataaaggcttgggcgctagcatcatcaatatgagcagtattatggggatggtaggcgatccgatgctgggggcatacaacgcttccaagggggcggtacgtatcatgtcgaaaagcgcagcgctggattgcgcactgaaggactacgatgtgcgtgtcaacacagtacatccgggcgcgatcaagaccgaacggaaggatcagctggaaggttgggaggagatgatgtcacagcgtacgctgacccctatgggccacattggcgaaccgaatgacatcgcatggatctgtgtgtacctggcgtctgacgaatcgaaatttgcgacgggtgcagaatttgtggtcgacggcgggtacaccgcacag

SEQ ID NO: 278 - protein, 252 aa, Artificial Sequence
  Engineered Variant of Kred from Lactobacillus kefir
MTDRLKHKVAIVTGGTMGIGLAIADKFVEEGAKVVITGRHADVGEKAAKSIGGTDVIRFVQHDASEEAGWTSLFDTTEEAFGPVTTLVNNAGIGVIKSVERTTTEEWRKVLSVNLDGVFFGTRLGIQRMKNKGLGASIINMSSIMGMVGDPMLGAYNASKGAVRIMSKSAALDCALKDYDVRVNTVHPGAIKTERKDQLEGWEEMMSQRTLTPMGHIGEPNDIAWICVYLASDESKFATGAEFVVDGGYTAQ

SEQ ID NO: 279 - DNA, 756 bp, Artificial Sequence
  Engineered Variant of Kred from Lactobacillus kefir
atgaccgatcgtctgaagcataaagtagccatcgttaccggcgggacaatgggtatcggtttggcaatcgccgataaatttgtagaggagggtgcgaaagtagttattactggtcgtgaggcggatgtaggtgaaaaagccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggttattaaaagcgttgaacggactaccacggaggaatggcgtaaagttctgtccgttaatctggatggtgtttttttcggcacccgtctgggcattcagcgcatgaaaaataaaggcttgggcgctagcatcatcaatatgagcagtattatggggctcgtaggcgatccgactctgggggcatacaacgcttccaagggggcggtacgtatcatgtcgaaaagcgcagcgctggattgcgcactgaaggacatggatgtgcgtgtcaacacagtacatccgggcgcgatcaagaccgaacggaaggatcagctggaaggttgggaggaaatgatgtcacagcgtacgctgacccctatgggccacattggcgaaccgaatgacatcgcatggatctgtgtgtacctggcgtctgacgaatcgaaatttgcgacgggtgcagaatttgtggtcgacggcgggtggaccgcacag

SEQ ID NO: 280 - protein, 252 aa, Artificial Sequence
  Engineered Variant of Kred from Lactobacillus kefir
MTDRLKHKVAIVTGGTMGIGLAIADKFVEEGAKVVITGREADVGEKAAKSIGGTDVIRFVQHDASEEAGWTKLFDTTEEAFGPVTTLVNNAGIGVIKSVERTTTEEWRKVLSVNLDGVFFGTRLGIQRMKNKGLGASIINMSSIMGLVGDPTLGAYNASKGAVRIMSKSAALDCALKDMDVRVNTVHPGAIKTERKDQLEGWEEMMSQRTLTPMGHIGEPNDIAWICVYLASDESKFATGAEFVVDGGWTAQ

SEQ ID NO: 281 - DNA, 756 bp, Artificial Sequence
  Engineered Variant of Kred from Lactobacillus kefir
atgaccgaccgtctgaagcacaaagtagccatcgttaccggcgggacaatgggtatcggtttggcaatcgccgataaatttgtagaggagggtgcgaaagtagttattactggtcgtcacgcggatgtaggtgaaaaagccgccaaatcaatcggtggcagtgatgttattcgctttgtccagcacgatgcgtcggaagaagcaggctggacgtcgctgttcgacaccaccgaggaggcattcggcccggttacgaccctggtgaacaatgcagggattggggttattaaaagcgttgaacggactacgacggaggaatggcgtaaagttctgtccgttaatctggatggtgtttttttcggcacccgtctgggcattcagcgcatgaaaaataaaggcttgggcgctagcatcatcaatatgagcagtattatggggctggtaggcgatccgactctgggggcatacaacgcttccaagggggcggtacgtatcatgtcgaaaagcgcagcgctggattgcgcactgaaggacatggatgtgcgtgtcaacacagtacatccgggcgcgatcaagaccgaacggaaggatcagctggaaggttgggaggagatgatgtcacagcgtacgctgacccctatgggccacattggcgaaccgaatgacatcgcatggatctgtgtgtacctggcgtctgacgaatcgaaatttgcgacgggtgcagaatttgtggtcgacggcgggtggaccgcacag

SEQ ID NO: 282 - protein, 252 aa, Artificial Sequence
  Engineered Variant of Kred from Lactobacillus kefir
MTDRLKHKVAIVTGGTMGIGLAIADKFVEEGAKVVITGRHADVGEKAAKSIGGSDVIRFVQHDASEEAGWTSLFDTTEEAFGPVTTLVNNAGIGVIKSVERTTTEEWRKVLSVNLDGVFFGTRLGIQRMKNKGLGASIINMSSIMGLVGDPTLGAYNASKGAVRIMSKSAALDCALKDMDVRVNTVHPGAIKTERKDQLEGWEEMMSQRTLTPMGHIGEPNDIAWICVYLASDESKFATGAEFVVDGGWTAQ

SEQ ID NO: 283 - DNA, 756 bp, Artificial Sequence
  Engineered Variant of Kred from Lactobacillus kefir
atgaccgaccgtctgaagcagaaagtagccatcgttaccggcgggacaatgggtatcggtttggcaatcgccgataaatttgtagaggagggtgcgaaagtagttattactggtcgtcacgcggatgtaggtgaaaaagccgccaaatcaatcggcggcactgatgttattcgctttgtccagcacgatgcgtccgaagaagcaggctggacgaaactgttcgacaccaccgaggaggcattcggcccggttacgaccctggtgaacaatgcagggattggggttattaaaagcgttgaacggactaccacggaggaatggcgtaaagttctgtccgttaatctggatggtgtttttttcggcacccgtctgggcattcagcgcatgaaaaataaaggcttgggcgctagcatcatcaatatgagcagtattatggggctggtaggcgatccgatgctgggggcatacaacgcttccaagggggcggtacgtatcatgtcgaaaagcgcagcgctggattgcgcactgaaggacatggatgtgcgtgtcaacacagtacatccgggcgcgatcaagaccgaacggaaggatcagctggaaggttgggaggaaatgatgtcacagcgtacgctgacccctatgggccacattggcgaaccgaatgacatcgcatggatctgtgtgtacctggcgtctgacgaatcgaaatttgcgacgggtgcagaatttgtggtcgacggcgggtggaccgcacag

SEQ ID NO: 284 - protein, 252 aa, Artificial Sequence
  Engineered Variant of Kred from Lactobacillus kefir
MTDRLKQKVAIVTGGTMGIGLAIADKFVEEGAKVVITGRHADVGEKAAKSIGGTDVIRFVQHDASEEAGWTKLFDTTEEAFGPVTTLVNNAGIGVIKSVERTTTEEWRKVLSVNLDGVFFGTRLGIQRMKNKGLGASIINMSSIMGLVGDPMLGAYNASKGAVRIMSKSAALDCALKDMDVRVNTVHPGAIKTERKDQLEGWEEMMSQRTLTPMGHIGEPNDIAWICVYLASDESKFATGAEFVVDGGWTAQ

SEQ ID NO: 285 - DNA, 756 bp, Artificial Sequence
  Engineered Variant of Kred from Lactobacillus kefir
atgaccgatcgtctgaagcacaaagtagccatcgtcaccggcgggacaatgggtatcggtttggcaatcgccgataaatttgtagaggagggtgcgaaagtagttattactggtcgtcacgcggatgtaggtctgaaagccgccaaatcaatcggtggcagtgatgttattcgctttgtccagcacgatgcgtccgaagaagcaggctggacgagtctgttcgacaccaccgaggaggcattcggcccggttacgaccctggtgaacaatgcagggattggggtaattaagagcgttgaacggactaccacggaggaatggcgtaaagttctgtccgttaatctggatggtgtttttttcggcacccgtctgggcattcagcgcatgaaaaataaaggcttgggcgctagcatcatcaatatgagcagtattatggggctggtaggctatccggcggccggggcatacaacgcttccaagggggcggtacgtatcatgtcgaaaagcgcagcgctggattgcgcactgaaggactacgatgtgcgtgtcaacacagtacatccgggcgcgatcaagaccgagcggaaggatcagctggaaggttgggagcaggcaatgtcacagcgtacggcgacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 286 - protein, 252 aa, Artificial Sequence
  Engineered Variant of Kred from Lactobacillus kefir
MTDRLKHKVAIVTGGTMGIGLAIADKFVEEGAKVVITGRHADVGLKAAKSIGGSDVIRFVQHDASEEAGWTSLFDTTEEAFGPVTTLVNNAGIGVIKSVERTTTEEWRKVLSVNLDGVFFGTRLGIQRMKNKGLGASIINMSSIMGLVGYPAAGAYNASKGAVRIMSKSAALDCALKDYDVRVNTVHPGAIKTERKDQLEGWEQAMSQRTATPMGHIGEPNDIAWICVYLASDESKFATGAEFVVDGGWTAQ

SEQ ID NO: 287 - DNA, 756 bp, Artificial Sequence
  Engineered Variant of Kred from Lactobacillus kefir
atgaccgatcgtctgaagcacaaagtagccatcgtcaccggcgggacaatgggtatcggtttggcaatcgccgataaatttgtagaggagggtgcgaaagtagttattactggtcgtcacgcggatgtaggtctgaaagccgccaaatcaatcggtggcagtgatgttattcgctttgtccagcacgatgcgtccgaagaagcaggctggacgagtctgttcgacaccaccgaggaggcattcggcccggttacgaccctggtgaacaatgcagggattggggtaattaaaagcgttgaacggactaccacggaggaatggcgtaaagttctgtccgttaatctggatggtgtttttttcggcacccgtctgggcattcagcgcatgaaaaataaaggcttgggcgctagcatcatcaatatgagcagtattatggggctggtaggctatccgtcggccggggcatacaacgcttccaagggggcggtacgtatcatgtcgaaaagcgcagcgctggattgcgcactgaaggactacgatgtgcgtgtcaacacagtacatccgggcgcgatcaagaccgagcggaaggatcagctggaaggttgggagcaggcaatgtcacagcgtacggcgacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 288 - protein, 252 aa, Artificial Sequence
  Engineered Variant of Kred from Lactobacillus kefir
MTDRLKHKVAIVTGGTMGIGLAIADKFVEEGAKVVITGRHADVGLKAAKSIGGSDVIRFVQHDASEEAGWTSLFDTTEEAFGPVTTLVNNAGIGVIKSVERTTTEEWRKVLSVNLDGVFFGTRLGIQRMKNKGLGASIINMSSIMGLVGYPSAGAYNASKGAVRIMSKSAALDCALKDYDVRVNTVHPGAIKTERKDQLEGWEQAMSQRTATPMGHIGEPNDIAWICVYLASDESKFATGAEFVVDGGWTAQ

SEQ ID NO: 289 - DNA, 756 bp, Artificial Sequence
  Engineered Variant of Kred from Lactobacillus kefir
atgaccgatcgtctgaagcacaaagtagccatcgtcaccggcgggacaatgggtatcggtttggcaatcgccgataaatttgtagaggagggtgcgaaagtagttattactggtcgtcacgcggatgtaggtctgaaagccgccaaatcaatcggtggcagtgatgttattcgctttgtccagcacgatgcgtccgaagaagcaggctggacgagtctgttcgacaccaccgaggaggcattcggcccggttacgaccctggtgaacaatgcagggattggggtaattaagagcgttgaacggactaccacggaggaatggcgtaaagttctgtccgttaatctggatggtgtttttttcggcacccgtctgggcattcagcgcatgaaaaataaaggcttgggcgctagcatcatcaatatgagcagtattatggggctggtaggcgctccgatggcaggggcatacaacgcttccaagggggcggtacgtatcatgtcgaaaagcgcagcgctggattgcgcactgaaggactacgatgtgcgtgtcaacacagtacatccgggcgcgatcaagacctcggctaaagatcagctggaaggttgggagcaggcaatgtcacagcgtacggcgacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 290 - protein, 252 aa, Artificial Sequence
  Engineered Variant of Kred from Lactobacillus kefir
MTDRLKHKVAIVTGGTMGIGLAIADKFVEEGAKVVITGRHADVGLKAAKSIGGSDVIRFVQHDASEEAGWTSLFDTTEEAFGPVTTLVNNAGIGVIKSVERTTTEEWRKVLSVNLDGVFFGTRLGIQRMKNKGLGASIINMSSIMGLVGAPMAGAYNASKGAVRIMSKSAALDCALKDYDVRVNTVHPGAIKTSAKDQLEGWEQAMSQRTATPMGHIGEPNDIAWICVYLASDESKFATGAEFVVDGGWTAQ

SEQ ID NO: 291 - DNA, 756 bp, Artificial Sequence
  Engineered Variant of Kred from Lactobacillus kefir
atgaccgatcgtctgaagcacaaagtagccatcgtcaccggcgggacaatgggtatcggtttggcaatcgccgataaatttgtagaggagggtgcgaaagtagttattactggtcgtcacgcggatgtaggtctgaaagccgccaaatcaatcggtggcagtgatgttattcgctttgtccagcacgatgcgtccgaagaagcaggctggacgagtctgttcgacaccaccgaggaggcattcggcccggttacgaccctggtgaacaatgcagccgagggcgtcattaagagcgttgaacggactaccacggaggaatggcgtaaagttctgtccgttaatctggatggtgtttttttcggcacccgtctgggcattcagcgcatgaaaaataaaggcttgggcgctagcatcatcaatatgagcagtattatggggctggtaggcgctccgatggcaggggcatacaacgcttccaagggggcggtacgtatcatgtcgaaaagcgcagcgctggattgcgcactgaaggactacgatgtgcgtgtcaacacagtacatccgggcgcgatcaagaccgagcggaaggatcagctggaaggttgggagcaggcaatgtcacagcgtacggcgacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 292 - protein, 252 aa, Artificial Sequence
  Engineered Variant of Kred from Lactobacillus kefir
MTDRLKHKVAIVTGGTMGIGLAIADKFVEEGAKVVITGRHADVGLKAAKSIGGSDVIRFVQHDASEEAGWTSLFDTTEEAFGPVTTLVNNAAEGVIKSVERTTTEEWRKVLSVNLDGVFFGTRLGIQRMKNKGLGASIINMSSIMGLVGAPMAGAYNASKGAVRIMSKSAALDCALKDYDVRVNTVHPGAIKTERKDQLEGWEQAMSQRTATPMGHIGEPNDIAWICVYLASDESKFATGAEFVVDGGWTAQ

SEQ ID NO: 293 - DNA, 756 bp, Artificial Sequence
  Engineered Variant of Kred from Lactobacillus kefir
atgaccgatcgtctgaagcacaaagtagccatcgtcaccggcgggacaatgggtatcggtttggcaatcgccgataaatttgtagaggagggtgcgaaagtagttattactggtcgtcacgcggatgtaggtctgaaagccgccaaatcaatcggtggcagtgatgttattcgctttgtccagcacgatgcgtccgaagaagcaggctggacgagtctgttcgacaccaccgaggaggcattcggcccggttacgaccctggtgaacaatgcagggattggggtaattaaaagcgttgaacggactaccacggaggaatggcgtaaagttctgtccgttaatctggatggtgtttttttcggcacccgtctgggcattcagcgcatgaaaaataaaggcttgggcgctagcatcatcaatatgagcagtattatggggctggtaggcgatccggcgctgggggcatacaacgcttccaagggggcggtacgtatcatgtcgaaaagcgcagcgctggattgcgcactgaaggactacgatgtgcgtgtcaacacagtacatccgggcgcgatcaagaccgagcggaaggatcagctggaaggttgggagcaggcaatgtcacagcgtacggcgacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 294 - protein, 252 aa, Artificial Sequence
  Engineered Variant of Kred from Lactobacillus kefir
MTDRLKHKVAIVTGGTMGIGLAIADKFVEEGAKVVITGRHADVGLKAAKSIGGSDVIRFVQHDASEEAGWTSLFDTTEEAFGPVTTLVNNAGIGVIKSVERTTTEEWRKVLSVNLDGVFFGTRLGIQRMKNKGLGASIINMSSIMGLVGDPALGAYNASKGAVRIMSKSAALDCALKDYDVRVNTVHPGAIKTERKDQLEGWEQAMSQRTATPMGHIGEPNDIAWICVYLASDESKFATGAEFVVDGGWTAQ

SEQ ID NO: 295 - DNA, 756 bp, Artificial Sequence
  Engineered Variant of Kred from Lactobacillus kefir
atgaccgaccgtctgaagcacaaagtagccatcattaccggcgggacaatgggtatcggtttggcaatcgccgataaatttgtagaggagggtgcgaaagtagttattactggtcgtcacgcggatgtaggtgaaaaagccgccaaatcaatcggtggcagtgatgttattcgctttgtccagcacgatgcgtcggaagaagcaggctggacgacgctgttcgacaccaccgaggaggcattcggcccggttacgaccctggtgaacaatgcaggtgatggccgtattaaaagcgttgaacggactaccacggaggaatggcgtaaagttctgtccgttaatctggatggtgtttttttcggcacccgtctgggcattcagcgcatgaaaaataaaggcttgggcgctagcatcatcaatatgagcagtattatggggctcgtaggcgatccgatgctgggggcatacaacgcttccaagggggcggtacgtatcatgtcgaaaagcgcagcgctggattgcgcactgaaggactacgatgtgcgtgtcaacacagtacatccgggcgcgatcaagaccgaacggaaggatcagctggaaggttgggaggagatgatgtcacagcgtacgctgacccctatgggccacattggcgaaccgaatgacatcgcatggatctgtgtgtacctggcgtctgacgaatcgaaatttgcgacgggtgcagaatttgtggtcgacggcgggtacaccgcacag

SEQ ID NO: 296 - protein, 252 aa, Artificial Sequence
  Engineered Variant of Kred from Lactobacillus kefir
MTDRLKHKVAIITGGTMGIGLAIADKFVEEGAKVVITGRHADVGEKAAKSIGGSDVIRFVQHDASEEAGWTTLFDTTEEAFGPVTTLVNNAGDGRIKSVERTTTEEWRKVLSVNLDGVFFGTRLGIQRMKNKGLGASIINMSSIMGLVGDPMLGAYNASKGAVRIMSKSAALDCALKDYDVRVNTVHPGAIKTERKDQLEGWEEMMSQRTLTPMGHIGEPNDIAWICVYLASDESKFATGAEFVVDGGYTAQ

SEQ ID NO: 297 - DNA, 756 bp, Artificial Sequence
  Engineered Variant of Kred from Lactobacillus kefir
atgaccgaccgtctgaagcacaaagtagccatcattaccggcgggacaatgggtatcggtttggcaatcgccgataaatttgtagaggagggtgcgaaagtagttattactggtcgtcacgcggatgtaggtgaaaaagccgccaaatcaatcggtggcagtgatgttattcgctttgtccagcacgatgcgtcggaagaagcaggctggacgacgctgttcgacaccaccgaggaggcattcggcccggttacgaccctggtgaacaatgcaggtgctggcaaaattaaaagcgttgaacggactaccacggaggaatggcgtcgtgttctgtccgtgaatctggatggtgtttttttcggcacccgtctgggcattcagcgcatgaaaaataaaggcttgggcgctagcatcatcaatatgagcagtattatggggctcgtaggcgatccgatgctgggggcatacaacgcttccaagggggcggtacgtatcatgtcgaaaagcgcagcgctggattgcgcactgaaggactacgatgtgcgtgtcaacacagtacatccgggcgcgatcaagaccgaacggaaggatcagctggaaggttgggaggagatgatgtcacagcgtacgctgacccctatgggccacattggcgaaccgaatgacatcgcatggatctgtgtgtacctggcgtctgacgaatcgaaatttgcgacgggtgcagaatttgtggtcgacggcgggtacaccgcacag

SEQ ID NO: 298 - protein, 252 aa, Artificial Sequence
  Engineered Variant of Kred from Lactobacillus kefir
MTDRLKHKVAIITGGTMGIGLAIADKFVEEGAKVVITGRHADVGEKAAKSIGGSDVIRFVQHDASEEAGWTTLFDTTEEAFGPVTTLVNNAGAGKIKSVERTTTEEWRRVLSVNLDGVFFGTRLGIQRMKNKGLGASIINMSSIMGLVGDPMLGAYNASKGAVRIMSKSAALDCALKDYDVRVNTVHPGAIKTERKDQLEGWEEMMSQRTLTPMGHIGEPNDIAWICVYLASDESKFATGAEFVVDGGYTAQ

SEQ ID NO: 299 - DNA, 756 bp, Artificial Sequence
  Engineered Variant of Kred from Lactobacillus kefir
atgaccgaccgtctgaagcacaaagtagccatcattaccggcgggacaatgggtatcggtttggcaatcgccgataaatttgtagaggagggtgcgaaagtagttattactggtcgtcacgcggatgtaggtgaaaaagccgccaaatcaatcggtggcagtgatgttattcgctttgtccagcacgatgcgtcggaagaagcaggctggacgacgctgttcgacaccaccgaggaggcattcggcccggttacgaccctggtgaacaatgcaggtgctggccgtattaaaagcgttgaacggactaccacggaggaatggcgtgatgttctgtccgtgacgctggatggtgtttttttcggcacccgtctgggcattcagcgcatgaaaaataaaggcttgggcgctagcatcatcaatatgagcagtattatggggctcgtaggcgatccgatgctgggggcatacaacgcttccaagggggcggtacgtatcatgtcgaaaagcgcagcgctggattgcgcactgaaggactacgatgtgcgtgtcaacacagtacatccgggcgcgatcaagaccgaacggaaggatcagctggaaggttgggaggagatgatgtcacagcgtacgctgacccctatgggccacattggcgaaccgaatgacatcgcatggatctgtgtgtacctggcgtctgacgaatcgaaatttgcgacgggtgcagaatttgtggtcgacggcgggtacaccgcacag

SEQ ID NO: 300 - protein, 252 aa, Artificial Sequence
  Engineered Variant of Kred from Lactobacillus kefir
MTDRLKHKVAIITGGTMGIGLAIADKFVEEGAKVVITGRHADVGEKAAKSIGGSDVIRFVQHDASEEAGWTTLFDTTEEAFGPVTTLVNNAGAGRIKSVERTTTEEWRDVLSVTLDGVFFGTRLGIQRMKNKGLGASIINMSSIMGLVGDPMLGAYNASKGAVRIMSKSAALDCALKDYDVRVNTVHPGAIKTERKDQLEGWEEMMSQRTLTPMGHIGEPNDIAWICVYLASDESKFATGAEFVVDGGYTAQ

SEQ ID NO: 301 - DNA, 756 bp, Artificial Sequence
  Engineered Variant of Kred from Lactobacillus kefir
atgaccgaccgtctgaagcacaaagtagccatcattaccggcgggacaatgggtatcggtttggcaatcgccgataaatttgtagaggagggtgcgaaagtagttattactggtcgtcacgcggatgtaggtgaaaaagccgccaaatcaatcggtggcagtgatgttattcgctttgtccagcacgatgcgtcggaagaagcaggctggacgacgctgttcgacaccaccgaggaggcattcggcccggttacgaccctggtgaacaatgcaggtcgtggcgccattaaaagcgttgaacggactaccacggaggaatggcgtaaagttctgtccgtgacgctggatggtgtttttttcggcacccgtctgggcattcagcgcatgaaaaataaaggcttgggcgctagcatcatcaatatgagcagtattatggggctcgtaggcgatccgatgctgggggcatacaacgcttccaagggggcggtacgtatcatgtcgaaaagcgcagcgctggattgcgcactgaaggactacgatgtgcgtgtcaacacagtacatccgggcgcgatcaagaccgaacggaaggatcagctggaaggttgggaggagatgatgtcacagcgtacgctgacccctatgggccacattggcgaaccgaatgacatcgcatggatctgtgtgtacctggcgtctgacgaatcgaaatttgcgacgggtgcagaatttgtggtcgacggcgggtacaccgcacag

SEQ ID NO: 302 - protein, 252 aa, Artificial Sequence
  Engineered Variant of Kred from Lactobacillus kefir
MTDRLKHKVAIITGGTMGIGLAIADKFVEEGAKVVITGRHADVGEKAAKSIGGSDVIRFVQHDASEEAGWTTLFDTTEEAFGPVTTLVNNAGRGAIKSVERTTTEEWRKVLSVTLDGVFFGTRLGIQRMKNKGLGASIINMSSIMGLVGDPMLGAYNASKGAVRIMSKSAALDCALKDYDVRVNTVHPGAIKTERKDQLEGWEEMMSQRTLTPMGHIGEPNDIAWICVYLASDESKFATGAEFVVDGGYTAQ

SEQ ID NO: 303 - DNA, 756 bp, Artificial Sequence
  Engineered Variant of Kred from Lactobacillus kefir
atgaccgaccgtctgaagcacaaagtagccatcattaccggcgggacaatgggtatcggtttggcaatcgccgataaatttgtagaggagggtgcgaaagtagttattactggtcgtcacgcggatgtaggtgaaaaagccgccaaatcaatcggtggcagtgatgttattcgctttgtccagcacgatgcgtcggaagaagcaggctggacgacgctgttcgacaccaccgaggaggcattcggcccggttacgaccctggtgaacaatgcagggatgggggttattaaaagcgttgaacggactaccacggaggaatggcgtaaagttctgtccgttaatctggatggtgtttttttcggcacccgtctgggcattcagcgcatgaaaaataaaggcttgggcgctagcatcatcaatatgagcagtattatggggctcgtaggcgatccgatgctgggggcatacaacgcttccaagggggcggtacgtatcatgtcgaaaagcgcagcgctggattgcgcactgaaggactacgatgtgcgtgtcaacacagtacatccgggcgcgatcaagaccgaacggaaggatcagctggaaggttgggaggagatgatgtcacagcgtacgctgacccctatgggccacattggcgaaccgaatgacatcgcatggatctgtgtgtacctggcgtctgacgaatcgaaatttgcgacgggtgcagaatttgtggtcgacggcgggtacaccgcacag

SEQ ID NO: 304 - protein, 252 aa, Artificial Sequence
  Engineered Variant of Kred from Lactobacillus kefir
MTDRLKHKVAIITGGTMGIGLAIADKFVEEGAKVVITGRHADVGEKAAKSIGGSDVIRFVQHDASEEAGWTTLFDTTEEAFGPVTTLVNNAGMGVIKSVERTTTEEWRKVLSVNLDGVFFGTRLGIQRMKNKGLGASIINMSSIMGLVGDPMLGAYNASKGAVRIMSKSAALDCALKDYDVRVNTVHPGAIKTERKDQLEGWEEMMSQRTLTPMGHIGEPNDIAWICVYLASDESKFATGAEFVVDGGYTAQ

SEQ ID NO: 305 - DNA, 756 bp, Artificial Sequence
  Engineered Variant of Kred from Lactobacillus kefir
atgaccgaccgtctgaagcacaaagtagccatcattaccggcgggacaatgggtatcggtttggcaatcgccgataaatttgtagaggagggtgcgaaagtagttattactggtcgtcacgcggatgtaggtgaaaaagccgccaaatcaatcggtggcagtgatgttattcgctttgtccagcacgatgcgtcggaagaagcaggctggacgacgctgttcgacaccaccgaggaggcattcggcccggttacgaccctggtgaacaatgcaggtgagggcgtcattaaaagcgttgaacggactaccacggaggaatggcgtcgtgttctgtccgtggcgctggatggtgtttttttcggcacccgtctgggcattcagcgcatgaaaaataaaggcttgggcgctagcatcatcaatatgagcagtattatggggctcgtaggcgatccgatgctgggggcatacaacgcttccaagggggcggtacgtatcatgtcgaaaagcgcagcgctggattgcgcactgaaggactacgatgtgcgtgtcaacacagtacatccgggcgcgatcaagaccgaacggaaggatcagctggaaggttgggaggagatgatgtcacagcgtacgctgacccctatgggccacattggcgaaccgaatgacatcgcatggatctgtgtgtacctggcgtctgacgaatcgaaatttgcgacgggtgcagaatttgtggtcgacggcgggtacaccgcacag

SEQ ID NO: 306 - protein, 252 aa, Artificial Sequence
  Engineered Variant of Kred from Lactobacillus kefir
MTDRLKHKVAIITGGTMGIGLAIADKFVEEGAKVVITGRHADVGEKAAKSIGGSDVIRFVQHDASEEAGWTTLFDTTEEAFGPVTTLVNNAGEGVIKSVERTTTEEWRRVLSVALDGVFFGTRLGIQRMKNKGLGASIINMSSIMGLVGDPMLGAYNASKGAVRIMSKSAALDCALKDYDVRVNTVHPGAIKTERKDQLEGWEEMMSQRTLTPMGHIGEPNDIAWICVYLASDESKFATGAEFVVDGGYTAQ

SEQ ID NO: 307 - DNA, 756 bp, Artificial Sequence
  Engineered Variant of Kred from Lactobacillus kefir
atgaccgaccgtctgaagcacaaagtagccatcattaccggcgggacaatgggtatcggtttggcaatcgccgataaatttgtagaggagggtgcgaaagtagttattactggtcgtcacgcggatgtaggtgaaaaagccgccaaatcaatcggtggcagtgatgttattcgctttgtccagcacgatgcgtcggaagaagcaggctggacgacgctgttcgacaccaccgaggaggcattcggcccggttacgaccctggtgaacaatgcagggattggggttattaaaagcgttgaacggactaccacggaggaatggcgtaaagttctgtccgtggcgctggatggtgtttttttcggcacccgtctgggcattcagcgcatgaaaaataaaggcttgggcgctagcatcatcaatatgagcagtattatggggctcgtaggcgatccgatgctgggggcatacaacgcttccaagggggcggtacgtatcatgtcgaaaagcgcagcgctggattgcgcactgaaggactacgatgtgcgtgtcaacacagtacatccgggcgcgatcaagaccgaacggaaggatcagctggaaggttgggaggagatgatgtcacagcgtacgctgacccctatgggccacattggcgaaccgaatgacatcgcatggatctgtgtgtacctggcgtctgacgaatcgaaatttgcgacgggtgcagaatttgtggtcgacggcgggtacaccgcacag

SEQ ID NO: 308 - protein, 252 aa, Artificial Sequence
  Engineered Variant of Kred from Lactobacillus kefir
MTDRLKHKVAIITGGTMGIGLAIADKFVEEGAKVVITGRHADVGEKAAKSIGGSDVIRFVQHDASEEAGWTTLFDTTEEAFGPVTTLVNNAGIGVIKSVERTTTEEWRKVLSVALDGVFFGTRLGIQRMKNKGLGASIINMSSIMGLVGDPMLGAYNASKGAVRIMSKSAALDCALKDYDVRVNTVHPGAIKTERKDQLEGWEEMMSQRTLTPMGHIGEPNDIAWICVYLASDESKFATGAEFVVDGGYTAQ

SEQ ID NO: 309 - DNA, 756 bp, Artificial Sequence
  Engineered Variant of Kred from Lactobacillus kefir
atgaccgaccgtctgaagcacaaagtagccatcattaccggcgggacaatgggtatcggtttggcaatcgccgataaatttgtagaggagggtgcgaaagtagttattactggtcgtcacgcggatgtaggtgaaaaagccgccaaatcaatcggtggcagtgatgttattcgctttgtccagcacgatgcgtcggaagaagcaggctggacgacgctgttcgacaccaccgaggaggcattcggcccggttacgaccctggtgaacaatgcagctgatggccgtattaaaagcgttgaacggactaccacggaggaatggcgtaaagttctgtccgttaatctggatggtgtttttttcggcacccgtctgggcattcagcgcatgaaaaataaaggcttgggcgctagcatcatcaatatgagcagtattatggggctcgtaggcgatccgatgctgggggcatacaacgcttccaagggggcggtacgtatcatgtcgaaaagcgcagcgctggattgcgcactgaaggactacgatgtgcgtgtcaacacagtacatccgggcgcgatcaagaccgaacggaaggatcagctggaaggttgggaggagatgatgtcacagcgtacgctgacccctatgggccacattggcgaaccgaatgacatcgcatggatctgtgtgtacctggcgtctgacgaatcgaaatttgcgacgggtgcagaatttgtggtcgacggcgggtacaccgcacag

SEQ ID NO: 310 - protein, 252 aa, Artificial Sequence
  Engineered Variant of Kred from Lactobacillus kefir
MTDRLKHKVAIITGGTMGIGLAIADKFVEEGAKVVITGRHADVGEKAAKSIGGSDVIRFVQHDASEEAGWTTLFDTTEEAFGPVTTLVNNAADGRIKSVERTTTEEWRKVLSVNLDGVFFGTRLGIQRMKNKGLGASIINMSSIMGLVGDPMLGAYNASKGAVRIMSKSAALDCALKDYDVRVNTVHPGAIKTERKDQLEGWEEMMSQRTLTPMGHIGEPNDIAWICVYLASDESKFATGAEFVVDGGYTAQ

SEQ ID NO: 311 - DNA, 756 bp, Artificial Sequence
  Engineered Variant of Kred from Lactobacillus kefir
atgaccgatcgtctgaagcacaaagtagccatcgtcaccggcgggacaatgggtatcggtttggcaatcgccgataaatttgtagaggagggtgcgaaagtagttattactggtcgtcacgcggatgtaggtctgaaagccgccaaatcaatcggtggcagtgatgttattcgctttgtccagcacgatgcgtccgaagaagcaggctggacgagtctgttcgacaccaccgaggaggcattcggcccggttacgaccctggtgaacaatgcagggattggggtggccaagagcgttgaacggactaccacggaggaatggcgtaaagttctgtccgttaatctggatggtgtttttttcggcacccgtctgggcattcagcgcatgaaaaataaaggcttgggcgctagcatcatcaatatgagcagtattatggggctggtaggctatccggcggccggggcatacaacgcttccaagggggcggtacgtatcatgtcgaaaagcgcagcgctggattgcgcactgaaggactacgatgtgcgtgtcaacacagtacatccgggcgcgatcaagaccgagcggaaggatcagctggaaggttgggagcaggcaatgtcacagcgtacggcgacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 312 - protein, 252 aa, Artificial Sequence
  Engineered Variant of Kred from Lactobacillus kefir
MTDRLKHKVAIVTGGTMGIGLAIADKFVEEGAKVVITGRHADVGLKAAKSIGGSDVIRFVQHDASEEAGWTSLFDTTEEAFGPVTTLVNNAGIGVAKSVERTTTEEWRKVLSVNLDGVFFGTRLGIQRMKNKGLGASIINMSSIMGLVGYPAAGAYNASKGAVRIMSKSAALDCALKDYDVRVNTVHPGAIKTERKDQLEGWEQAMSQRTATPMGHIGEPNDIAWICVYLASDESKFATGAEFVVDGGWTAQ

SEQ ID NO: 313 - DNA, 756 bp, Artificial Sequence
  Engineered Variant of Kred from Lactobacillus kefir
atgaccgatcgtctgaagcacaaagtagccatcgtcaccggcgggacaatgggtatcggtttggcaatcgccgataaatttgtagaggagggtgcgaaagtagttattactggtcgtcacgcggatgtaggtctgaaagccgccaaatcaatcggtggcagtgatgttattcgctttgtccagcacgatgcgtccgaagaagcaggctggacgagtctgttcgacaccaccgaggaggcattcggcccggttacgaccctggtgaacaatgcagggattggggtgatcaagagcgttgaacggactaccacggaggaatggcgtaaagttctgtccgttaatctggatggtgtttttttcggcacccgtctgggcattcagcgcatgaaaaataaaggcttgggcgctagcatcatcaatatgagctcgatcgcagggctggtaggcgccccggccgccggggcatacaacgcttccaagggggcggtacgtatcatgtcgaaaagcgcagcgctggattgcgcactgaaggactacgatgtgcgtgtcaacacagtacatccgggcgcgatcaagaccgagcggaaggatcagctggaaggttgggagcaggcaatgtcacagcgtacggcgacccctatgggccacattggcgaaccgaatgacatcgcatggatctgtgtgtacctggcatctgacgaatcgaaatttgcgacgggtgcagaatttgtggtcgacggcgggtggaccgcacag

SEQ ID NO: 314 - protein, 252 aa, Artificial Sequence
  Engineered Variant of Kred from Lactobacillus kefir
MTDRLKHKVAIVTGGTMGIGLAIADKFVEEGAKVVITGRHADVGLKAAKSIGGSDVIRFVQHDASEEAGWTSLFDTTEEAFGPVTTLVNNAGIGVIKSVERTTTEEWRKVLSVNLDGVFFGTRLGIQRMKNKGLGASIINMSSIAGLVGAPAAGAYNASKGAVRIMSKSAALDCALKDYDVRVNTVHPGAIKTERKDQLEGWEQAMSQRTATPMGHIGEPNDIAWICVYLASDESKFATGAEFVVDGGWTAQ

SEQ ID NO: 315 - DNA, 756 bp, Artificial Sequence
  Engineered Variant of Kred from Lactobacillus kefir
atgaccgatcgtctgaagcacaaagtagccatcatcaccggcgggacaatgggtatcggtttggcaatcgccgataaatttgtagaggagggtgcgaaagtagttattactggtcgtcacgcggatgtaggtgagaaagccgccaaatcaatcggtggcagtgatgttattcgctttgtccagcacgatgcgtccgaagaagcaggctggacgagcctgttcgacaccaccgaggaggcattcggcccggttacgaccctggtgaacaatgcagggattggggtaattaagagcgttgaacggactaccacggaggaatggcgtaaagttctgtccgttaatctggatggtgtttttttcggcacccgtctgggcattcagcgcatgaaaaataaaggcttgggcgctagcatcatcaatatgagcagtattatggggctggtaggctatccggccgccggggcatacaacgcttccaagggggcggtacgtatcatgtcgaaaagcgcagcgctggattgcgcactgaaggactacgatgtgcgtgtcaacacagtacatccgggcgcgatcaagaccgagcggaaggatcagctggaaggttgggagcaggcaatgtcacagcgtacggcgacccctatgggccacattggcgaaccgaatgacatcgcatggatctgtgtgtacctggcatctgacgaatcgaaatttgcgacgggtgcagaatttgtggtcgacggcgggtacaccgcacag

SEQ ID NO: 316 - protein, 252 aa, Artificial Sequence
  Engineered Variant of Kred from Lactobacillus kefir
MTDRLKHKVAIITGGTMGIGLAIADKFVEEGAKVVITGRHADVGEKAAKSIGGSDVIRFVQHDASEEAGWTSLFDTTEEAFGPVTTLVNNAGIGVIKSVERTTTEEWRKVLSVNLDGVFFGTRLGIQRMKNKGLGASIINMSSIMGLVGYPAAGAYNASKGAVRIMSKSAALDCALKDYDVRVNTVHPGAIKTERKDQLEGWEQAMSQRTATPMGHIGEPNDIAWICVYLASDESKFATGAEFVVDGGYTAQ

SEQ ID NO: 317 - DNA, 756 bp, Artificial Sequence
  Engineered Variant of Kred from Lactobacillus kefir
atgaccgatcgtctgaagcacaaagtagccatcgtcaccggcgggacaatgggtatcggtttggcaatcgccgataaatttgtagaggagggtgcgaaagtagttattactggtcgtcacgcggatgtaggtgagaaagccgccaaatcaatcggtggcagtgatgttattcgctttgtccagcacgatgcgtccgaagaagcaggctggacgagtctgttcgacaccaccgaggaggcattcggcccggttacgaccctggtgaacaatgcagggattggggtaattaagagcgttgaacggactaccacggaggaatggcgtaaagttctgtccgttaatctggatggtgtttttttcggcacccgtctgggcattcagcgcatgaaaaataaaggcttgggcgctagcatcatcaatatgagcagtattatggggctggtaggctatccggccgccggggcatacaacgcttccaagggggcggtacgtatcatgtcgaaaagcgcagcgctggattgcgcactgaaggactacgatgtgcgtgtcaacacagtacatccgggcgcgatcaagaccgagcggaaggatcagctggaaggttgggagcaggcaatgtcacagcgtacggcgacccctatgggccacattggcgaaccgaatgacatcgcatggatctgtgtgtacctggcatctgacgaatcgaaatttgcgacgggtgcagaatttgtggtcgacggcgggtacaccgcacag

SEQ ID NO: 318 - protein, 252 aa, Artificial Sequence
  Engineered Variant of Kred from Lactobacillus kefir
MTDRLKHKVAIVTGGTMGIGLAIADKFVEEGAKVVITGRHADVGEKAAKSIGGSDVIRFVQHDASEEAGWTSLFDTTEEAFGPVTTLVNNAGIGVIKSVERTTTEEWRKVLSVNLDGVFFGTRLGIQRMKNKGLGASIINMSSIMGLVGYPAAGAYNASKGAVRIMSKSAALDCALKDYDVRVNTVHPGAIKTERKDQLEGWEQAMSQRTATPMGHIGEPNDIAWICVYLASDESKFATGAEFVVDGGYTAQ

SEQ ID NO: 319 - DNA, 756 bp, Artificial Sequence
  Engineered Variant of Kred from Lactobacillus kefir
atgaccgatcgtctgaagcacaaagtagccatcgtcaccggcgggacaatgggtatcggtttggcaatcgccgataaatttgtagaggagggtgcgaaagtagttattactggtcgtcacgcggatgtaggtgagaaagccgccaaatcaatcggtggcagtgatgttattcgctttgtccagcacgatgcgtccgaagaagcaggctggacgagtctgttcgacaccaccgaggaggcattcggcccggttacgaccctggtgaacaatgcagggattggggtaattaagagcgttgaacggactaccacggaggaatggcgtgatgttctgtccgttaatctggatggtgtttttttcggcacccgtctgggcattcagcgcatgaaaaataaaggcttgggcgctagcatcatcaatatgagcagtattatggggctggtaggctatccggccgccggggcatacaacgcttccaagggggcggtacgtatcatgtcgaaaagcgcagcgctggattgcgcactgaaggactacgatgtgcgtgtcaacacagtacatccgggcgcgatcaagaccgagcggaaggatcagctggaaggttgggagcaagcaatgtcacagcgtacggcgacccctatgggccacattggcgaaccgaatgacatcgcatggatctgtgtgtacctggcatctgacgaatcgaaatttgcgacgggtgcagaatttgtggtcgacggcgggtacaccgcacag

SEQ ID NO: 320 - protein, 252 aa, Artificial Sequence
  Engineered Variant of Kred from Lactobacillus kefir
MTDRLKHKVAIVTGGTMGIGLAIADKFVEEGAKVVITGRHADVGEKAAKSIGGSDVIRFVQHDASEEAGWTSLFDTTEEAFGPVTTLVNNAGIGVIKSVERTTTEEWRDVLSVNLDGVFFGTRLGIQRMKNKGLGASIINMSSIMGLVGYPAAGAYNASKGAVRIMSKSAALDCALKDYDVRVNTVHPGAIKTERKDQLEGWEQAMSQRTATPMGHIGEPNDIAWICVYLASDESKFATGAEFVVDGGYTAQ

SEQ ID NO: 321 - DNA, 756 bp, Artificial Sequence
  Engineered Variant of Kred from Lactobacillus kefir
atgaccgatcgtctgaagcacaaagtagccatcgtcaccggcgggacaatgggtatcggtttggcaatcgccgataaatttgtagaggagggtgcgaaagtagttattactggtcgtcacgcggatgtaggtgagaaagccgccaaatcaatcggtggcagtgatgttattcgctttgtccagcacgatgcgtccgaagaagcaggctggacgaccctgttcgacaccaccgaggaggcattcggcccggttacgaccctggtgaacaatgcagggattggggtaattaagagcgttgaacggactaccacggaggaatggcgtaaagttctgtccgttaatctggatggtgtttttttcggcacccgtctgggcattcagcgcatgaaaaataaaggcttgggcgctagcatcatcaatatgagcagtattatggggctggtaggctatccggccgccggggcatacaacgcttccaagggggcggtacgtatcatgtcgaaaagcgcagcgctggattgcgcactgaaggactacgatgtgcgtgtcaacacagtacatccgggcgcgatcaagaccgagcggaaggatcagctggaaggttgggagcaggcaatgtcacagcgtacggcgacccctatgggccacattggcgaaccgaatgacatcgcatggatctgtgtgtacctggcatctgacgaatcgaaatttgcgacgggtgcagaatttgtggtcgacggcgggtacaccgcacag

SEQ ID NO: 322 - protein, 252 aa, Artificial Sequence
  Engineered Variant of Kred from Lactobacillus kefir
MTDRLKHKVAIVTGGTMGIGLAIADKFVEEGAKVVITGRHADVGEKAAKSIGGSDVIRFVQHDASEEAGWTTLFDTTEEAFGPVTTLVNNAGIGVIKSVERTTTEEWRKVLSVNLDGVFFGTRLGIQRMKNKGLGASIINMSSIMGLVGYPAAGAYNASKGAVRIMSKSAALDCALKDYDVRVNTVHPGAIKTERKDQLEGWEQAMSQRTATPMGHIGEPNDIAWICVYLASDESKFATGAEFVVDGGYTAQ

SEQ ID NO: 323 - DNA, 756 bp, Artificial Sequence
  Engineered Variant of Kred from Lactobacillus kefir
atgaccgatcgtctgaagcacaaagtagccatcatcaccggcgggacaatgggtatcggtttggcaatcgccgataaatttgtagaggagggtgcgaaagtagttattactggtcgtcacgcggatgtaggtgagaaagccgccaaatcaatcggtggcagtgatgttattcgctttgtccagcacgatgcgtccgaagaagcaggctggacgagcctgttcgacaccaccgaggaggcattcggcccggttacgaccctggtgaacaatgcaggggctggggtaattaagagcgttgaacggactaccacggaggaatggcgtaaagttctgtccgttaatctggatggtgtttttttcggcacccgtctgggcattcagcgcatgaaaaataaaggcttgggcgctagcatcatcaatatgagcagtattatggggctggtaggctatccggccgccggggcatacaacgcttccaagggggcggtacgtatcatgtcgaaaagcgcagcgctggattgcgcactgaaggactacgatgtgcgtgtcaacacagtacatccgggcgcgatcaagaccgagcggaaggatcagctggaaggttgggagcaggcaatgtcacagcgtacggcgacccctatgggccacattggcgaaccgaatgacatcgcatggatctgtgtgtacctggcatctgacgaatcgaaatttgcgacgggtgcagaatttgtggtcgacggcgggtacaccgcacag

SEQ ID NO: 324 - protein, 252 aa, Artificial Sequence
  Engineered Variant of Kred from Lactobacillus kefir
MTDRLKHKVAIITGGTMGIGLAIADKFVEEGAKVVITGRHADVGEKAAKSIGGSDVIRFVQHDASEEAGWTSLFDTTEEAFGPVTTLVNNAGAGVIKSVERTTTEEWRKVLSVNLDGVFFGTRLGIQRMKNKGLGASIINMSSIMGLVGYPAAGAYNASKGAVRIMSKSAALDCALKDYDVRVNTVHPGAIKTERKDQLEGWEQAMSQRTATPMGHIGEPNDIAWICVYLASDESKFATGAEFVVDGGYTAQ

SEQ ID NO: 325 - DNA, 756 bp, Artificial Sequence
  Engineered Variant of Kred from Lactobacillus kefir
atgaccgatcgtctgaagcacaaagtagccatcatcaccggcgggacaatgggtatcggtttggcaatcgccgataaatttgtagaggagggtgcgaaagtagttattactggtcgtcacgcggatgtaggtctgaaagccgccaaatcaatcggtggcagtgatgttattcgctttgtccagcacgatgcgtccgaagaagcaggctggacgagtctgttcgacaccaccgaggaggcattcggcccggttacgaccctggtgaacaatgcagggattggggtaattaagagcgttgaacggactaccacggaggaatggcgtgatgttctgtccgttaatctggatggtgtttttttcggcacccgtctgggcattcagcgcatgaaaaataaaggcttgggcgctagcatcatcaatatgagcagtattatggggctggtaggctatccggccgccggggcatacaacgcttccaagggggcggtacgtatcatgtcgaaaagcgcagcgctggattgcgcactgaaggactacgatgtgcgtgtcaacacagtacatccgggcgcgatcaagaccgagcggaaggatcagctggaaggttgggagcaggcaatgtcacagcgtacggcgacccctatgggccacattggcgaaccgaatgacatcgcatggatctgtgtgtacctggcatctgacgaatcgaaatttgcgacgggtgcagaatttgtggtcgacggcgggtacaccgcacag

SEQ ID NO: 326 - protein, 252 aa, Artificial Sequence
  Engineered Variant of Kred from Lactobacillus kefir
MTDRLKHKVAIITGGTMGIGLAIADKFVEEGAKVVITGRHADVGLKAAKSIGGSDVIRFVQHDASEEAGWTSLFDTTEEAFGPVTTLVNNAGIGVIKSVERTTTEEWRDVLSVNLDGVFFGTRLGIQRMKNKGLGASIINMSSIMGLVGYPAAGAYNASKGAVRIMSKSAALDCALKDYDVRVNTVHPGAIKTERKDQLEGWEQAMSQRTATPMGHIGEPNDIAWICVYLASDESKFATGAEFVVDGGYTAQ

SEQ ID NO: 327 - DNA, 756 bp, Artificial Sequence
  Engineered Variant of Kred from Lactobacillus kefir
atgaccgatcgtctgaagcacaaagtagccatcatcaccggcgggacaatgggtatcggtttggcaatcgccgataaatttgtagaggagggtgcgaaagtagttattactggtcgtcacgcggatgtaggtgagaaagccgccaaatcaatcggtggcagtgatgttattcgctttgtccagcacgatgcgtccgaagaagcaggctggacgaccctgttcgacaccaccgaggaggcattcggcccggttacgaccctggtgaacaatgcagggattggggtaattaagagcgttgaacggactaccacggaggaatggcgtgatgttctgtccgttaatctggatggtgtttttttcggcacccgtctgggcattcagcgcatgaaaaataaaggcttgggcgctagcatcatcaatatgagcagtattatggggctggtaggctatccggccgccggggcatacaacgcttccaagggggcggtacgtatcatgtcgaaaagcgcagcgctggattgcgcactgaaggactacgatgtgcgtgtcaacacagtacatccgggcgcgatcaagaccgagcggaaggatcagctggaaggttgggagcaggcaatgtcacagcgtacggcgacccctatgggccacattggcgaaccgaatgacatcgcatggatctgtgtgtacctggcatctgacgaatcgaaatttgcgacgggtgcagaatttgtggtcgacggcgggtacaccgcacag

SEQ ID NO: 328 - protein, 252 aa, Artificial Sequence
  Engineered Variant of Kred from Lactobacillus kefir
MTDRLKHKVAIITGGTMGIGLAIADKFVEEGAKVVITGRHADVGEKAAKSIGGSDVIRFVQHDASEEAGWTTLFDTTEEAFGPVTTLVNNAGIGVIKSVERTTTEEWRDVLSVNLDGVFFGTRLGIQRMKNKGLGASIINMSSIMGLVGYPAAGAYNASKGAVRIMSKSAALDCALKDYDVRVNTVHPGAIKTERKDQLEGWEQAMSQRTATPMGHIGEPNDIAWICVYLASDESKFATGAEFVVDGGYTAQ

SEQ ID NO: 329 - DNA, 756 bp, Artificial Sequence
  Engineered Variant of Kred from Lactobacillus kefir
atgaccgatcgtctgaagcacaaagtagccatcatcaccggcgggacaatgggtatcggtttggcaatcgccgataaatttgtagaggagggtgcgaaagtagttattactggtcgtcacgcggatgtaggtgagaaagccgccaaatcaatcggtggcagtgatgttattcgctttgtccagcacgatgcgtccgaagaagcaggctggacgaccctgttcgacaccaccgaggaggcattcggcccggttacgaccctggtgaacaatgcagggattggggtaattaagagcgttgaacggactaccacggaggaatggcgtgatgttctgtccgttaatctggatggtgtttttttcggcacccgtctgggcattcagcgcatgaaaaataaaggcttgggcgctagcatcatcaatatgagcagtattatggggctggtaggcgctccggccgccggggcatacaacgcttccaagggggcggtacgtatcatgtcgaaaagcgcagcgctggattgcgcactgaaggactacgatgtgcgtgtcaacacagtacatccgggcgcgatcaagaccgagtcgaaggatcagctggaaggttgggagcaggcaatgtcacagcgtacggcgacccctatgggccacattggcgaaccgaatgacatcgcatggatctgtgtgtacctggcatctgacgaatcgaaatttgcgacgggtgcagaatttgtggtcgacggcgggtacaccgcacag

SEQ ID NO: 330 - protein, 252 aa, Artificial Sequence
  Engineered Variant of Kred from Lactobacillus kefir
MTDRLKHKVAIITGGTMGIGLAIADKFVEEGAKVVITGRHADVGEKAAKSIGGSDVIRFVQHDASEEAGWTTLFDTTEEAFGPVTTLVNNAGIGVIKSVERTTTEEWRDVLSVNLDGVFFGTRLGIQRMKNKGLGASIINMSSIMGLVGAPAAGAYNASKGAVRIMSKSAALDCALKDYDVRVNTVHPGAIKTESKDQLEGWEQAMSQRTATPMGHIGEPNDIAWICVYLASDESKFATGAEFVVDGGYTAQ

SEQ ID NO: 331 - DNA, 756 bp, Artificial Sequence
  Engineered Variant of Kred from Lactobacillus kefir
atgaccgatcgtctgaagcacaaagtagccatcatcaccggcgggacaatgggtatcggtttggcaatcgccgataaatttgtagaggagggtgcgaaagtagttattactggtcgtcacgcggatgtaggtgagaaagccgccaaatcaatcggtggcagtgatgttattcgctttgtccagcacgatgcgtccgaagaagcaggctggacgaccctgttcgacaccaccgaggaggcattcggcccggttacgaccctggtgaacaatgcagggattggggtaattaagagcgttgaacggactaccacggaggaatggcgtgatgttctgtccgttaatctggatggtgtttttttcggcacccgtctgggcattcagcgcatgaaaaataaaggcttgggcgctagcatcatcaatatgagcagtattatggggctggtaggcgctccggccgccggggcatacaacgcttccaagggggcggtacgtatcatgtcgaaaagcgcagcgctggattgcgcactgaaggactacgatgtgcgtgtcaacacagtacatccgggcgcgatcaagaccgagcggaaggatcagctggaaggttgggagcaggcaatgtcacagcgtacggcgacccctatgggccacattggcgaaccgaatgacatcgcatggatctgtgtgtacctggcatctgacgaatcgaaatttgcgacgggtgcagaatttgtggtcgacggcgggtacaccgcacag

SEQ ID NO: 332 - protein, 252 aa, Artificial Sequence
  Engineered Variant of Kred from Lactobacillus kefir
MTDRLKHKVAIITGGTMGIGLAIADKFVEEGAKVVITGRHADVGEKAAKSIGGSDVIRFVQHDASEEAGWTTLFDTTEEAFGPVTTLVNNAGIGVIKSVERTTTEEWRDVLSVNLDGVFFGTRLGIQRMKNKGLGASIINMSSIMGLVGAPAAGAYNASKGAVRIMSKSAALDCALKDYDVRVNTVHPGAIKTERKDQLEGWEQAMSQRTATPMGHIGEPNDIAWICVYLASDESKFATGAEFVVDGGYTAQ

SEQ ID NO: 333 - DNA, 756 bp, Artificial Sequence
  Engineered Variant of Kred from Lactobacillus kefir
atgaccgatcgtctgaagcacaaagtagccatcatcaccggcgggacaatgggtatcggtttggcaatcgccgataaatttgtagaggagggtgcgaaagtagttattactggtcgtcacgcggatgtaggtgagaaagccgccaaatcaatcggtggcagtgatgttattcgctttgtccagcacgatgcgtccgaagaagcaggctggacgaccctgttcgacaccaccgaggaggcattcggcccggttacgaccctggtgaacaatgcagggattggggtaattaagagcgttgaacggactaccacggaggaatggcgtgatgttctgtccgttaatctggatggtgtttttttcggcacccgtctgggcattcagcgcatgaaaaataaaggcttgggcgctagcatcatcaatatgagcagtattatggggctggtaggctatccggccgccggggcatacaacgcttccaagggggcggtacgtatcatgtcgaaaagcgcagcgctggattgcgcactgaaggactacgatgtgcgtgtcaacacagtacatccgggcgcgatcaagaccgagtcgaaggatcagctggaaggttgggagcaggcaatgtcacagcgtacggcgacccctatgggccacattggcgaaccgaatgacatcgcatggatctgtgtgtacctggcatctgacgaatcgaaatttgcgacgggtgcagaatttgtggtcgacggcgggtacaccgcacag

SEQ ID NO: 334 - protein, 252 aa, Artificial Sequence
  Engineered Variant of Kred from Lactobacillus kefir
MTDRLKHKVAIITGGTMGIGLAIADKFVEEGAKVVITGRHADVGEKAAKSIGGSDVIRFVQHDASEEAGWTTLFDTTEEAFGPVTTLVNNAGIGVIKSVERTTTEEWRDVLSVNLDGVFFGTRLGIQRMKNKGLGASIINMSSIMGLVGYPAAGAYNASKGAVRIMSKSAALDCALKDYDVRVNTVHPGAIKTESKDQLEGWEQAMSQRTATPMGHIGEPNDIAWICVYLASDESKFATGAEFVVDGGYTAQ

SEQ ID NO: 335 - DNA, 756 bp, Artificial Sequence
  Engineered Variant of Kred from Lactobacillus kefir
atgaccgatcgtctgaagcacaaagtagccatcatcaccggcgggacaatgggtatcggtttggcaatcgccgataaatttgtagaggagggtgcgaaagtagttattactggtcgtcacgcggatgtaggtgagaaagccgccaaatcaatcggtggcagtgatgttattcgctttgtccagcacgatgcgtccgaagaagcaggctggacgaccctgttcgacaccaccgaggaggcattcggcccggttacgaccctggtgaacaatgcagggattggggtaattaagagcgttgaacggactaccacggaggaatggcgtgatgttctgtccgttaatctggatggtgtttttttcggcacccgtctgggcattcagcgcatgaaaaataaaggcttgggcgctagcatcatcaatatgagcagtattatggggctggtaggctatccggccgccggggcatacaacgcttccaagggggcggtacgtatcatgtcgaaaagcgcagcgctggattgcgcactgaaggactacgatgtgcgtgtcaacacagtacatccgggcgcgatcaagaccgaggcgaaggatcagctggaaggttgggagcaggcaatgtcacagcgtacggcgacccctatgggccacattggcgaaccgaatgacatcgcatggatctgtgtgtacctggcatctgacgaatcgaaatttgcgacgggtgcagaatttgtggtcgacggcgggtacaccgcacag

SEQ ID NO: 336 - protein, 252 aa, Artificial Sequence
  Engineered Variant of Kred from Lactobacillus kefir
MTDRLKHKVAIITGGTMGIGLAIADKFVEEGAKVVITGRHADVGEKAAKSIGGSDVIRFVQHDASEEAGWTTLFDTTEEAFGPVTTLVNNAGIGVIKSVERTTTEEWRDVLSVNLDGVFFGTRLGIQRMKNKGLGASIINMSSIMGLVGYPAAGAYNASKGAVRIMSKSAALDCALKDYDVRVNTVHPGAIKTEAKDQLEGWEQAMSQRTATPMGHIGEPNDIAWICVYLASDESKFATGAEFVVDGGYTAQ

SEQ ID NO: 337 - DNA, 756 bp, Artificial Sequence; identical to SEQ ID NO: 333
  Engineered Variant of Kred from Lactobacillus kefir

SEQ ID NO: 338 - protein, 252 aa, Artificial Sequence; identical to SEQ ID NO: 334
  Engineered Variant of Kred from Lactobacillus kefir

SEQ ID NO: 339 - DNA, 756 bp, Artificial Sequence
  Engineered Variant of Kred from Lactobacillus kefir
atgaccgatcgtctgaagcacaaagtagccatcatcaccggcgggacaatgggtatcggtttggcaatcgccgataaatttgtagaggagggtgcgaaagtagttattactggtcgtcacgcggatgtaggtgagaaagccgccaaatcaatcggtggcagtgatgttattcgctttgtccagcacgatgcgtccgaagaagcaggctggacgaccctgttcgacaccaccgaggaggcattcggcccggttacgaccctggtgaacaatgcagggattggggtaattaagagcgttgaacggactaccacggaggaatggcgtgatgttctgtccgttaatctggatggtgtttttttcggcacccgtctgggcattcagcgcatgaaaaataaaggcttgggcgctagcatcatcaatatgagcagtattatggggctggtaggcgctgccgccgccggggcatacaacgcttccaagggggcggtacgtatcatgtcgaaaagcgcagcgctggattgcgcactgaaggactacgatgtgcgtgtcaacacagtacatccgggcgcgatcaagaccgagcgcaaggatcagctggaaggttgggagcaggcaatgtcacagcgtacggcgacccctatgggccacattggcgaaccgaatgacatcgcatggatctgtgtgtacctggcatctgacgaatcgaaatttgcgacgggtgcagaatttgtggtcgacggcgggtacaccgcacag

SEQ ID NO: 340 - protein, 252 aa, Artificial Sequence
  Engineered Variant of Kred from Lactobacillus kefir
MTDRLKHKVAIITGGTMGIGLAIADKFVEEGAKVVITGRHADVGEKAAKSIGGSDVIRFVQHDASEEAGWTTLFDTTEEAFGPVTTLVNNAGIGVIKSVERTTTEEWRDVLSVNLDGVFFGTRLGIQRMKNKGLGASIINMSSIMGLVGAAAAGAYNASKGAVRIMSKSAALDCALKDYDVRVNTVHPGAIKTERKDQLEGWEQAMSQRTATPMGHIGEPNDIAWICVYLASDESKFATGAEFVVDGGYTAQ

SEQ ID NO: 341 - DNA, 756 bp, Artificial Sequence; identical to SEQ ID NO: 329
  Engineered Variant of Kred from Lactobacillus kefir

SEQ ID NO: 342 - protein, 252 aa, Artificial Sequence; identical to SEQ ID NO: 330
  Engineered Variant of Kred from Lactobacillus kefir

SEQ ID NO: 343 - DNA, 756 bp, Artificial Sequence
  Engineered Variant of Kred from Lactobacillus kefir
atgaccgatcgtctgaagcacaaagtagccatcatcaccggcgggacaatgggtatcggtttggcaatcgccgataaatttgtagaggagggtgcgaaagtagttattactggtcgtcacgcggatgtaggtgagaaagccgccaaatcaatcggtggcagtgatgttattcgctttgtccagcacgatgcgtccgaagaagcaggctggacgaccctgttcgacaccaccgaggaggcattcggcccggttacgaccctggtgaacaatgcagggatcgggcgtattaagagcgttgaacggactaccacggaggaatggcgtgatgttctgtccgttaatctggatggtgtttttttcggcacccgtctgggcattcagcgcatgaaaaataaaggcttgggcgctagcatcatcaatatgagcagtattatggggctggtaggcgctccggccgccggggcatacaacgcttccaagggggcggtacgtatcatgtcgaaaagcgcagcgctggattgcgcactgaaggactacgatgtgcgtgtcaacacagtacatccgggcgcgatcaagaccgagcgcaaggatcagctggaaggttgggagcaggcaatgtcacagcgtacggcgacccctatgggccacattggcgaaccgaatgacatcgcatggatctgtgtgtacctggcatctgacgaatcgaaatttgcgacgggtgcagaatttgtggtcgacggcgggtacaccgcacag

SEQ ID NO: 344 - protein, 252 aa, Artificial Sequence
  Engineered Variant of Kred from Lactobacillus kefir
MTDRLKHKVAIITGGTMGIGLAIADKFVEEGAKVVITGRHADVGEKAAKSIGGSDVIRFVQHDASEEAGWTTLFDTTEEAFGPVTTLVNNAGIGRIKSVERTTTEEWRDVLSVNLDGVFFGTRLGIQRMKNKGLGASIINMSSIMGLVGAPAAGAYNASKGAVRIMSKSAALDCALKDYDVRVNTVHPGAIKTERKDQLEGWEQAMSQRTATPMGHIGEPNDIAWICVYLASDESKFATGAEFVVDGGYTAQ

SEQ ID NO: 345 - DNA, 756 bp, Artificial Sequence
  Engineered Variant of Kred from Lactobacillus kefir
atgaccgatcgtctgaagcacaaagtagccatcatcaccggcgggacaatgggtatcggtttggcaatcgccgataaatttgtagaggagggtgcgaaagtagttattactggtcgtcacgcggatgtaggtgagaaagccgccaaatcaatcggtggcagtgatgttattcgctttgtccagcacgatgcgtccgaagaagcaggctggacgaccctgttcgacaccaccgaggaggcattcggcccggttacgaccctggtgaacaatgcaggggcaggggtcattaagagcgttgaacggactaccacggaggaatggcgtgatgttctgtccgttaatctggatggtgtttttttcggcacccgtctgggcattcagcgcatgaaaaataaaggcttgggcgctagcatcatcaatatgagcagtattatggggctggtaggcgctccggccgccggggcatacaacgcttccaagggggcggtacgtatcatgtcgaaaagcgcagcgctggattgcgcactgaaggactacgatgtgcgtgtcaacacagtacatccgggcgcgatcaagaccgagcgcaaggatcagctggaaggttgggagcaggcaatgtcacagcgtacggcgacccctatgggccacattggcgaaccgaatgacatcgcatggatctgtgtgtacctggcatctgacgaatcgaaatttgcgacgggtgcagaatttgtggtcgacggcgggtacaccgcacag

SEQ ID NO: 346 - protein, 252 aa, Artificial Sequence
  Engineered Variant of Kred from Lactobacillus kefir
MTDRLKHKVAIITGGTMGIGLAIADKFVEEGAKVVITGRHADVGEKAAKSIGGSDVIRFVQHDASEEAGWTTLFDTTEEAFGPVTTLVNNAGAGVIKSVERTTTEEWRDVLSVNLDGVFFGTRLGIQRMKNKGLGASIINMSSIMGLVGAPAAGAYNASKGAVRIMSKSAALDCALKDYDVRVNTVHPGAIKTERKDQLEGWEQAMSQRTATPMGHIGEPNDIAWICVYLASDESKFATGAEFVVDGGYTAQ

SEQ ID NO: 347 - DNA, 756 bp, Artificial Sequence
  Engineered Variant of Kred from Lactobacillus kefir
atgaccgatcgtctgaagcacaaagtagccatcatcaccggcgggacaatgggtatcggtttggcaatcgccgataaatttgtagaggagggtgcgaaagtagttattactggtcgtcacgcggatgtaggtgagaaagccgccaaatcaatcggtggcagtgatgttattcgctttgtccagcacgatgcgtccgaagaagcaggctggacgaccctgttcgacaccaccgaggaggcattcggcccggttacgaccctggtgaacaatgcaggggcagggcgtattaagagcgttgaacggactaccacggaggaatggcgtgatgttctgtccgttaatctggatggtgtttttttcggcacccgtctgggcattcagcgcatgaaaaataaaggcttgggcgctagcatcatcaatatgagcagtattgctgggctggtaggcgctccggccgccggggcatacaacgcttccaagggggcggtacgtatcatgtcgaaaagcgcagcgctggattgcgcactgaaggactacgatgtgcgtgtcaacacagtacatccgggcgcgatcaagaccgagcgcaaggatcagctggaaggttgggagcaggcaatgtcacagcgtacggcgacccctatgggccacattggcgaaccgaatgacatcgcatggatctgtgtgtacctggcatctgacgaatcgaaatttgcgacgggtgcagaatttgtggtcgacggcgggtacaccgcacag

SEQ ID NO: 348 - protein, 252 aa, Artificial Sequence
  Engineered Variant of Kred from Lactobacillus kefir
MTDRLKHKVAIITGGTMGIGLAIADKFVEEGAKVVITGRHADVGEKAAKSIGGSDVIRFVQHDASEEAGWTTLFDTTEEAFGPVTTLVNNAGAGRIKSVERTTTEEWRDVLSVNLDGVFFGTRLGIQRMKNKGLGASIINMSSIAGLVGAPAAGAYNASKGAVRIMSKSAALDCALKDYDVRVNTVHPGAIKTERKDQLEGWEQAMSQRTATPMGHIGEPNDIAWICVYLASDESKFATGAEFVVDGGYTAQ

SEQ ID NO: 349 - DNA, 756 bp, Artificial Sequence
  Engineered Variant of Kred from Lactobacillus kefir
atgaccgatcgtctgaagcacaaagtagccatcatcaccggcgggacaatgggtatcggtttggcaatcgccgataaatttgtagaggagggtgcgaaagtagttattactggtcgtcacgcggatgtaggtgagaaagccgccaaatcaatcggtggcagtgatgttattcgctttgtccagcacgatgcgtccgaagaagcaggctggacgaccctgttcgacaccaccgaggaggcattcggcccggttacgaccctggtgaacaatgcaggggcaggggtcattaagagcgttgaacggactaccacggaggaatggcgtaaagttctgtccgtcactctggatggtgtttttttcggcacccgtctgggcattcagcgcatgaaaaataaaggcttgggcgctagcatcatcaatatgagcagtattgctgggctggtaggcgctccggccgccggggcatacaacgcttccaagggggcggtacgtatcatgtcgaaaagcgcagcgctggattgcgcactgaaggactacgatgtgcgtgtcaacacagtacatccgggcgcgatcaagaccgagcgcaaggatcagctggaaggttgggagcaggcaatgtcacagcgtacggcgacccctatgggccacattggcgaaccgaatgacatcgcatggatctgtgtgtacctggcatctgacgaatcgaaatttgcgacgggtgcagaatttgtggtcgacggcgggtacaccgcacag

SEQ ID NO: 350 - protein, 252 aa, Artificial Sequence
  Engineered Variant of Kred from Lactobacillus kefir
MTDRLKHKVAIITGGTMGIGLAIADKFVEEGAKVVITGRHADVGEKAAKSIGGSDVIRFVQHDASEEAGWTTLFDTTEEAFGPVTTLVNNAGAGVIKSVERTTTEEWRKVLSVTLDGVFFGTRLGIQRMKNKGLGASIINMSSIAGLVGAPAAGAYNASKGAVRIMSKSAALDCALKDYDVRVNTVHPGAIKTERKDQLEGWEQAMSQRTATPMGHIGEPNDIAWICVYLASDESKFATGAEFVVDGGYTAQ

SEQ ID NO: 351 - DNA, 756 bp, Artificial Sequence
  Engineered Variant of Kred from Lactobacillus kefir
atgaccgatcgtctgaagcacaaagtagccatcatcaccggcgggacaatgggtatcggtttggcaatcgccgataaatttgtagaggagggtgcgaaagtagttattactggtcgtcacgcggatgtaggtgagaaagccgccaaatcaatcggtggcagtgatgttattcgctttgtccagcacgatgcgtccgaagaagcaggctggacgaccctgttcgacaccaccgaggaggcattcggcccggttacgaccctggtgaacaatgcagggattggggtaattaagagcgttgaacggactaccacggaggaatggcgtgatgttctgtccgttaatctggatggtgtttttttcggcacccgtctgggcattcagcgcatgaaaaataaaggcttgggcgctagcatcatcaatatgagcagtattgctgggctggtaggcgctccggccgccggggcatacaacgcttccaagggggcggtacgtatcatgtcgaaaagcgcagcgctggattgcgcactgaaggactacgatgtgcgtgtcaacacagtacatccgggcgcgatcaagaccgaggcgaaggatcagctggaaggttgggagcaggcaatgtcacagcgtacggcgacccctatgggccacattggcgaaccgaatgacatcgcatggatctgtgtgtacctggcatctgacgaatcgaaatttgcgacgggtgcagaatttgtggtcgacggcgggtacaccgcacag

SEQ ID NO: 352 - protein, 252 aa, Artificial Sequence
  Engineered Variant of Kred from Lactobacillus kefir
MTDRLKHKVAIITGGTMGIGLAIADKFVEEGAKVVITGRHADVGEKAAKSIGGSDVIRFVQHDASEEAGWTTLFDTTEEAFGPVTTLVNNAGIGVIKSVERTTTEEWRDVLSVNLDGVFFGTRLGIQRMKNKGLGASIINMSSIAGLVGAPAAGAYNASKGAVRIMSKSAALDCALKDYDVRVNTVHPGAIKTEAKDQLEGWEQAMSQRTATPMGHIGEPNDIAWICVYLASDESKFATGAEFVVDGGYTAQ

SEQ ID NO: 353 - DNA, 756 bp, Artificial Sequence
  Engineered Variant of Kred from Lactobacillus kefir
atgaccgatcgtctgaagcacaaagtagccatcatcaccggcgggacaatgggtatcggtttggcaatcgccgataaatttgtagaggagggtgcgaaagtagttattactggtcgtcacgcggatgtaggtgagaaagccgccaaatcaatcggtggcagtgatgttattcgctttgtccagcacgatgcgtccgaagaagcaggctggacgaccctgttcgacaccaccgaggaggcattcggcccggttacgaccctggtgaacaatgcagggatcggggtcattaagagcgttgaacggactaccacggaggaatggcgtgatgttctgtccgttaatctggatggtgtttttttcggcacccgtctgggcattcagcgcatgaaaaataaaggcttgggcgctagcatcatcaatatgagcagtattatggggctggtaggcgctccggccgccggggcatacaacgcttccaagggggcggtacgtatcatgtcgaaaagcgcagcgctggattgcgcactgaaggactacgatgtgcgtgtcaacacagtacatccgggcgcgatcaagaccgagcgcaaggatcagctggaaggttgggagcaggcaatgtcacagcgtacggcgacccctatgggccacattggcgaaccgaatgacatcgcatggatctgtgtgtacctggcatctgacgaatcgaaatttgcgacgggtgcagaatttgtggtcgacggcgggtacaccgcacag

SEQ ID NO: 354 - protein, 252 aa, Artificial Sequence; identical to SEQ ID NO: 332
  Engineered Variant of Kred from Lactobacillus kefir

SEQ ID NO: 355 - DNA, 756 bp, Artificial Sequence
  Engineered Variant of Kred from Lactobacillus kefir
atgaccgatcgtctgaagcacaaagtagccatcatcaccggcgggacaatgggtatcggtttggcaatcgccgataaatttgtagaggagggtgcgaaagtagttattactggtcgtcacgcggatgtaggtgaaaaagccgccaaatcaatcggtggcagtgatgttattcgctttgtccagcacgatgcgtccgaagaagcaggctggacgaagctgttcgacaccaccgaggaggcattcggcccggttacgaccctggtgaacaatgcagggattggggtaattaagagcgttgaacggactaccacggaggaatggcgtgatgttctgtccgttaatctggatggtgtttttttcggcacccgtctgggcattcagcgcatgaaaaataaaggcttgggcgctagcatcatcaatatgagcagtattatggggctggtaggcgctccgatggccggggcatacaacgcttccaagggggcggtacgtatcatgtcgaaaagcgcagcgctggattgcgcactgaaggactacgatgtgcgtgtcaacacagtacatccgggcgcgatcaagaccgagcgcaaggatcagctggaaggttgggagcaggcaatgtcacagcgtacggcgacccctatgggccacattggcgaaccgaatgacatcgcatggatctgtgtgtacctggcatctgacgaatcgaaatttgcgacgggtgcagaatttgtggtcgacggcgggtacaccgcacag

SEQ ID NO: 356 - protein, 252 aa, Artificial Sequence
  Engineered Variant of Kred from Lactobacillus kefir
MTDRLKHKVAIITGGTMGIGLAIADKFVEEGAKVVITGRHADVGEKAAKSIGGSDVIRFVQHDASEEAGWTKLFDTTEEAFGPVTTLVNNAGIGVIKSVERTTTEEWRDVLSVNLDGVFFGTRLGIQRMKNKGLGASIINMSSIMGLVGAPMAGAYNASKGAVRIMSKSAALDCALKDYDVRVNTVHPGAIKTERKDQLEGWEQAMSQRTATPMGHIGEPNDIAWICVYLASDESKFATGAEFVVDGGYTAQ

SEQ ID NO: 357 - DNA, 756 bp, Artificial Sequence
  Engineered Variant of Kred from Lactobacillus kefir
atgaccgatcgtctgaagcacaaagtagccatcgtcaccggcgggacaatgggtatcggtttggcaatcgccgataaatttgtagaggagggtgcgaaagtagttattactggtcgtcacgcggatgtaggtgaaaaagccgccaaatcaatcggtggcagtgatgttattcgctttgtccagcacgatgcgtccgaagaagcaggctggacgtcgctgttcgacaccaccgaggaggcattcggcccggttacgaccctggtgaacaatgcagggattggggtaattaagagcgttgaacggactaccacggaggaatggcgtaaggttctgtccgttaatctggatggtgtttttttcggcacccgtctgggcattcagcgcatgaaaaataaaggcttgggcgctagcatcatcaatatgagcagtattatggggctggtaggcgctccggccgccggggcatacaacgcttccaagggggcggtacgtatcatgtcgaaaagcgcagcgctggattgcgcactgaaggactacgatgtgcgtgtcaacacagtacatccgggcgcgatcaagaccgagcgcaaggatcagctggaaggttgggagcaggcaatgtcacagcgtacggcgacccctatgggccacattggcgaaccgaatgacatcgcatggatctgtgtgtacctggcatctgacgaatcgaaatttgcgacgggtgcagaatttgtggtcgacggcgggtacaccgcacag

SEQ ID NO: 358 - protein, 252 aa, Artificial Sequence
  Engineered Variant of Kred from Lactobacillus kefir
MTDRLKHKVAIVTGGTMGIGLAIADKFVEEGAKVVITGRHADVGEKAAKSIGGSDVIRFVQHDASEEAGWTSLFDTTEEAFGPVTTLVNNAGIGVIKSVERTTTEEWRKVLSVNLDGVFFGTRLGIQRMKNKGLGASIINMSSIMGLVGAPAAGAYNASKGAVRIMSKSAALDCALKDYDVRVNTVHPGAIKTERKDQLEGWEQAMSQRTATPMGHIGEPNDIAWICVYLASDESKFATGAEFVVDGGYTAQ

SEQ ID NO: 359 - DNA, 756 bp, Artificial Sequence
  Engineered Variant of Kred from Lactobacillus kefir
atgaccgatcgtctgaagcacaaagtagccatcatcaccggcgggacaatgggtatcggtttggcaatcgccgataaatttgtagaggagggtgcgaaagtagttattactggtcgtcacgcggatgtaggtgaaaaagccgccaaatcaatcggtggcagtgatgttattcgctttgtccagcacgatgcgtccgaagaagcaggctggacgtcgctgttcgacaccaccgaggaggcattcggcccggttacgaccctggtgaacaatgcagggattggggtaattaagagcgttgaacggactaccacggaggaatggcgtaaggttctgtccgttaatctggatggtgtttttttcggcacccgtctgggcattcagcgcatgaaaaataaaggcttgggcgctagcatcatcaatatgagcagtattatggggctggtaggcgctccgatggccggggcatacaacgcttccaagggggcggtacgtatcatgtcgaaaagcgcagcgctggattgcgcactgaaggactacgatgtgcgtgtcaacacagtacatccgggcgcgatcaagaccgagcgcaaggatcagctggaaggttgggagcaggcaatgtcacagcgtacggcgacccctatgggccacattggcgaaccgaatgacatcgcatggatctgtgtgtacctggcatctgacgaatcgaaatttgcgacgggtgcagaatttgtggtcgacggcgggtacaccgcacag

SEQ ID NO: 360 - protein, 252 aa, Artificial Sequence
  Engineered Variant of Kred from Lactobacillus kefir
MTDRLKHKVAIITGGTMGIGLAIADKFVEEGAKVVITGRHADVGEKAAKSIGGSDVIRFVQHDASEEAGWTSLFDTTEEAFGPVTTLVNNAGIGVIKSVERTTTEEWRKVLSVNLDGVFFGTRLGIQRMKNKGLGASIINMSSIMGLVGAPMAGAYNASKGAVRIMSKSAALDCALKDYDVRVNTVHPGAIKTERKDQLEGWEQAMSQRTATPMGHIGEPNDIAWICVYLASDESKFATGAEFVVDGGYTAQ

SEQ ID NO: 361 - DNA, 756 bp, Artificial Sequence
  Engineered Variant of Kred from Lactobacillus kefir
atgaccgatcgtctgaagcacaaagtagccatcatcaccggcgggacaatgggtatcggtttggcaatcgccgataaatttgtagaggagggtgcgaaagtagttattactggtcgtcacgcggatgtaggtgaaaaagccgccaaatcaatcggtggcagtgatgttattcgctttgtccagcacgatgcgtccgaagaagcaggctggacgtcgctgttcgacaccaccgaggaggcattcggcccggttacgaccctggtgaacaatgcagggattggggtaattaagagcgttgaacggactaccacggaggaatggcgtaaggttctgtccgttaatctggatggtgtttttttcggcacccgtctgggcattcagcgcatgaaaaataaaggcttgggcgctagcatcatcaatatgagcagtattatggggctggtaggcgctccggccgccggggcatacaacgcttccaagggggcggtacgtatcatgtcgaaaagcgcagcgctggattgcgcactgaaggactacgatgtgcgtgtcaacacagtacatccgggcgcgatcaagaccgagcgcaaggatcagctggaaggttgggagcaggcaatgtcacagcgtacggcgacccctatgggccacattggcgaaccgaatgacatcgcatggatctgtgtgtacctggcatctgacgaatcgaaatttgcgacgggtgcagaatttgtggtcgacggcgggtacaccgcacag

SEQ ID NO: 362 - protein, 252 aa, Artificial Sequence
  Engineered Variant of Kred from Lactobacillus kefir
MTDRLKHKVAIITGGTMGIGLAIADKFVEEGAKVVITGRHADVGEKAAKSIGGSDVIRFVQHDASEEAGWTSLFDTTEEAFGPVTTLVNNAGIGVIKSVERTTTEEWRKVLSVNLDGVFFGTRLGIQRMKNKGLGASIINMSSIMGLVGAPAAGAYNASKGAVRIMSKSAALDCALKDYDVRVNTVHPGAIKTERKDQLEGWEQAMSQRTATPMGHIGEPNDIAWICVYLASDESKFATGAEFVVDGGYTAQ

SEQ ID NO: 363 - DNA, 756 bp, Artificial Sequence
  Engineered Variant of Kred from Lactobacillus kefir
atgaccgatcgtctgaagcacaaagtagccatcatcaccggcgggacaatgggtatcggtttggcaatcgccgataaatttgtagaggagggtgcgaaagtagttattactggtcgtcacgcggatgtaggtgaaaaagccgccaaatcaatcggtggcagtgatgttattcgctttgtccagcacgatgcgtccgaagaagcaggctggacgaagctgttcgacaccaccgaggaggcattcggcccggttacgaccctggtgaacaatgcagggattggggtaattaagagcgttgaacggactaccacggaggaatggcgtgatgttctgtccgttaatctggatggtgtttttttcggcacccgtctgggcattcagcgcatgaaaaataaaggcttgggcgctagcatcatcaatatgagcagtattatggggctggtaggcgctccggccgccggggcatacaacgcttccaagggggcggtacgtatcatgtcgaaaagcgcagcgctggattgcgcactgaaggactacgatgtgcgtgtcaacacagtacatccgggcgcgatcaagaccgagcgcaaggatcagctggaaggttgggagcaggcaatgtcacagcgtacggcgacccctatgggccacattggcgaaccgaatgacatcgcatggatctgtgtgtacctggcatctgacgaatcgaaatttgcgacgggtgcagaatttgtggtcgacggcgggtacaccgcacag

SEQ ID NO: 364 - protein, 252 aa, Artificial Sequence
  Engineered Variant of Kred from Lactobacillus kefir
MTDRLKHKVAIITGGTMGIGLAIADKFVEEGAKVVITGRHADVGEKAAKSIGGSDVIRFVQHDASEEAGWTKLFDTTEEAFGPVTTLVNNAGIGVIKSVERTTTEEWRDVLSVNLDGVFFGTRLGIQRMKNKGLGASIINMSSIMGLVGAPAAGAYNASKGAVRIMSKSAALDCALKDYDVRVNTVHPGAIKTERKDQLEGWEQAMSQRTATPMGHIGEPNDIAWICVYLASDESKFATGAEFVVDGGYTAQ

SEQ ID NO: 365 - DNA, 756 bp, Artificial Sequence
  Engineered Variant of Kred from Lactobacillus kefir
atgaccgatcgtctgaagcacaaagtagccatcatcaccggcgggacaatgggtatcggtttggcaatcgccgataaatttgtagaggagggtgcgaaagtagttattactggtcgtcacgcggatgtaggtgagaaagccgccaaatcaatcggtggcagtgatgttattcgctttgtccagcacgatgcgtccgaagaagcaggctggacgaccctgttcgacaccaccgaggaggcattcggcccggttacgaccctggtgaacaatgcaggggccggggtaattaagagcgttgaacggactaccacggaggaatggcgtgatgttctgtccgttaatctggatggtgtttttttcggcacccgtctgggcattcagcgcatgaaaaataaaggcttgggcgctagcatcatcaatatgagcagtattatggggctggtaggcgctccggccgccggggcatacaacgcttccaagggggcggtacgtatcatgtcgaaaagcgcagcgctggattgcgcactgaaggactacgatgtgcgtgtcaacacagtacatccgggcgcgatcaagaccgagtcgaaggatcagctggaaggttgggagcaggcaatgtcacagcgtacggcgacccctatgggccacattggcgaaccgaatgacatcgcatggatctgtgtgtacctggcatctgacgaatcgaaatttgcgacgggtgcagaatttgtggtcgacggcgggtacaccgcacag

SEQ ID NO: 366 - protein, 252 aa, Artificial Sequence
  Engineered Variant of Kred from Lactobacillus kefir
MTDRLKHKVAIITGGTMGIGLAIADKFVEEGAKVVITGRHADVGEKAAKSIGGSDVIRFVQHDASEEAGWTTLFDTTEEAFGPVTTLVNNAGAGVIKSVERTTTEEWRDVLSVNLDGVFFGTRLGIQRMKNKGLGASIINMSSIMGLVGAPAAGAYNASKGAVRIMSKSAALDCALKDYDVRVNTVHPGAIKTESKDQLEGWEQAMSQRTATPMGHIGEPNDIAWICVYLASDESKFATGAEFVVDGGYTAQ

SEQ ID NO: 367 - DNA, 756 bp, Artificial Sequence
  Engineered Variant of Kred from Lactobacillus kefir
atgaccgatcgtctgaagcacaaagtagccatcatcaccggcgggacaatgggtatcggtttggcaatcgccgataaatttgtagaggagggtgcgaaagtagttattactggtcgtcacgcggatgtaggtgagaaagccgccaaatcaatcggtggcagtgatgttattcgctttgtccagcacgatgcgtccgaagaagcaggctggacgaccctgttcgacaccaccgaggaggcattcggcccggttacgaccctggtgaacaatgcagggattggggtaattaagagcgttgaacggactaccacggaggaatggcgtgatgttctgtccgttaatctggatggtgtttttttcggcacccgtctgggcattcagcgcatgaaaaataaaggcttgggcgctagcatcatcaatatgagcagtattatggggctggtaggcgctccggccgccggggcatacaacgcttccaagggggcggtacgtatcatgtcgaaaagcgcagcgctggattgcgcactgaaggactacgatgttcgtgtcaacacagtacatccgggcgcgatcaagaccaactcgaaggatcagctggagggttgggagcaggcaatgtcacagcgtacggcgacccctatgggccacattggcgaaccgaatgacatcgcatggatctgtgtgtacctggcatctgacgaatcgaaatttgcgacgggtgcagaatttgtggtcgacggcgggtacaccgcacag

SEQ ID NO: 368 - protein, 252 aa, Artificial Sequence
  Engineered Variant of Kred from Lactobacillus kefir
MTDRLKHKVAIITGGTMGIGLAIADKFVEEGAKVVITGRHADVGEKAAKSIGGSDVIRFVQHDASEEAGWTTLFDTTEEAFGPVTTLVNNAGIGVIKSVERTTTEEWRDVLSVNLDGVFFGTRLGIQRMKNKGLGASIINMSSIMGLVGAPAAGAYNASKGAVRIMSKSAALDCALKDYDVRVNTVHPGAIKTNSKDQLEGWEQAMSQRTATPMGHIGEPNDIAWICVYLASDESKFATGAEFVVDGGYTAQ

SEQ ID NO: 369 - DNA, 756 bp, Artificial Sequence
  Engineered Variant of Kred from Lactobacillus kefir
atgaccgatcgtctgaagcacaaagtagccatcatcaccggcgggacaatgggtatcggtttggcaatcgccgataaatttgtagaggagggtgcgaaagtagttattactggtcgtcacgcggatgtaggtgagaaagccgccaaatcaatcggtggcagtgatgttattcgctttgtccagcacgatgcgtccgaagaagcaggctggacgaccctgttcgacaccaccgaggaggcattcggcccggttacgaccctggtgaacaatgcagggattggggtaattaagagcgttgaacggactaccacggaggaatggcgtgatgttctgtccgttaatctggatggtgtttttttcggcacccgtctgggcattcagcgcatgaaaaataaaggcttgggcgctagcatcatcaatatgagcagtattatggggctggtaggcgctccggccgccggggcatacaacgcttccaagggggcggtacgtatcatgtcgaaaagcgcagcgctggattgcgcactgaaggactacgatgttcgtgtcaacacagtacatccgggcgcgatcaagaccaactcgaaggatcagctgccaggttgggagcaggcaatgtcacagcgtacggcgacccctatgggccacattggcgaaccgaatgacatcgcatggatctgtgtgtacctggcatctgacgaatcgaaatttgcgacgggtgcagaatttgtggtcgacggcgggtacaccgcacag

SEQ ID NO: 370 - protein, 252 aa, Artificial Sequence
  Engineered Variant of Kred from Lactobacillus kefir
MTDRLKHKVAIITGGTMGIGLAIADKFVEEGAKVVITGRHADVGEKAAKSIGGSDVIRFVQHDASEEAGWTTLFDTTEEAFGPVTTLVNNAGIGVIKSVERTTTEEWRDVLSVNLDGVFFGTRLGIQRMKNKGLGASIINMSSIMGLVGAPAAGAYNASKGAVRIMSKSAALDCALKDYDVRVNTVHPGAIKTNSKDQLPGWEQAMSQRTATPMGHIGEPNDIAWICVYLASDESKFATGAEFVVDGGYTAQ

SEQ ID NO: 371 - DNA, 756 bp, Artificial Sequence
  Engineered Variant of Kred from Lactobacillus kefir
atgaccgatcgtctgaagcacaaagtagccatcatcaccggcgggacaatgggtatcggtttggcaatcgccgataaatttgtagaggagggtgcgaaagtagttattactggtcgtcacgcggatgtaggtgagaaagccgccaaatcaatcggtggcagtgatgttattcgctttgtccagcacgatgcgtccgaagaagcaggctggacgaccctgttcgacaccaccgaggaggcattcggcccggttacgaccctggtgaacaatgcagggattggggtaattaagagcgttgaacggactaccacggaggaatggcgtgatgttctgtccgttaatctggatggtgtttttttcggcacccgtctgggcattcagcgcatgaaaaataaaggcttgggcgctagcatcatcaatatgagcagtattatggggctggtaggcgctccggccgccggggcatacaacgcttccaagggggcggtacgtatcatgtcgaaaagcgcagcgctggattgcgcactgaaggactacgatgtgcgtgtcaacacagtacatccgggcgcgatcaagaccgaatcgaaggatcagctgccaggttgggagcaggcaatgtcacagcgtacggcgacccctatgggccacattggcgaaccgaatgacatcgcatggatctgtgtgtacctggcatctgacgaatcgaaatttgcgacgggtgcagaatttgtggtcgacggcgggtacaccgcacag

SEQ ID NO: 372 - protein, 252 aa, Artificial Sequence
  Engineered Variant of Kred from Lactobacillus kefir
MTDRLKHKVAIITGGTMGIGLAIADKFVEEGAKVVITGRHADVGEKAAKSIGGSDVIRFVQHDASEEAGWTTLFDTTEEAFGPVTTLVNNAGIGVIKSVERTTTEEWRDVLSVNLDGVFFGTRLGIQRMKNKGLGASIINMSSIMGLVGAPAAGAYNASKGAVRIMSKSAALDCALKDYDVRVNTVHPGAIKTESKDQLPGWEQAMSQRTATPMGHIGEPNDIAWICVYLASDESKFATGAEFVVDGGYTAQ

SEQ ID NO: 373 - DNA, 756 bp, Artificial Sequence
  Engineered Variant of Kred from Lactobacillus kefir
atgaccgatcgtctgaagcacaaagtagccatcatcaccggcgggacaatgggtatcggtttggcaatcgccgataaatttgtagaggagggtgcgaaagtagttattactggtcgtcacgcggatgtaggtgagaaagccgccaaatcaatcggtggcagtgatgttattcgctttgtccagcacgatgcgtccgaagaagcaggctggacgaccctgttcgacaccaccgaggcggcattcggcccggttacgaccctggtgaacaatgcagggattggggtaattaagagcgttgaacggactaccacggaggaatggcgtgatgttctgtccgttaatctggatggtgtttttttcggcacccgtctgggcattcagcgcatgaaaaataaaggcttgggcgctagcatcatcaatatgagcagtattatggggctggtaggcgctccggccgccggggcatacaacgcttccaagggggcggtacgtatcatgtcgaaaagcgcagcgctggattgcgcactgaaggactacgatgtgcgtgtcaacacagtacatccgggcgcgatcaagaccgagtcgaaggatcagctggaaggttgggagcaggcaatgtcacagcgtacggcgacccctatgggccacattggcgaaccgaatgacatcgcatggatctgtgtgtacctggcatctgacgaatcgaaatttgcgacgggtgcagaatttgtggtcgacggcgggtacaccgcacag

SEQ ID NO: 374 - protein, 252 aa, Artificial Sequence
  Engineered Variant of Kred from Lactobacillus kefir
MTDRLKHKVAIITGGTMGIGLAIADKFVEEGAKVVITGRHADVGEKAAKSIGGSDVIRFVQHDASEEAGWTTLFDTTEAAFGPVTTLVNNAGIGVIKSVERTTTEEWRDVLSVNLDGVFFGTRLGIQRMKNKGLGASIINMSSIMGLVGAPAAGAYNASKGAVRIMSKSAALDCALKDYDVRVNTVHPGAIKTESKDQLEGWEQAMSQRTATPMGHIGEPNDIAWICVYLASDESKFATGAEFVVDGGYTAQ

SEQ ID NO: 375 - DNA, 756 bp, Artificial Sequence
  Engineered Variant of Kred from Lactobacillus kefir
atgaccgatcgtctgaagcacaaagtagccatcatcaccggcgggacaatgggtatcggtttggcaatcgccgataaatttgtagaggagggtgcgaaagtagttattactggtcgtcacgcggatgtaggtgagaaagccgccaaatcaatcggtggcagtgatgttattcgctttgtccagcacgatgcgtccgaagaagcaggctggacgaccctgttcgacaccaccgaggaggcattcggcccggttacgaccctggtgaacaatgcagggattggggttccgaagagcgttgaacggactaccacggaggaatggcgtgatgttctgtccgttaatctggatggtgtttttttcggcacccgtctgggcattcagcgcatgaaaaataaaggcttgggcgctagcatcatcaatatgagcagtattatggggctggtaggcgctccggccgccggggcatacaacgcttccaagggggcggtacgtatcatgtcgaaaagcgcagcgctggattgcgcactgaaggactacgatgtgcgtgtcaacacagtacatccgggcgcgatcaagaccaactcgaaggatcagctgccaggttgggagcaggcaatgtcacagcgtacggcgacccctatgggccacattggcgaaccgaatgacatcgcatggatctgtgtgtacctggcatctgacgaatcgaaatttgcgacgggtgcagaatttgtggtcgacggcgggtacaccgcacag

SEQ ID NO: 376 - protein, 252 aa, Artificial Sequence
  Engineered Variant of Kred from Lactobacillus kefir
MTDRLKHKVAIITGGTMGIGLAIADKFVEEGAKVVITGRHADVGEKAAKSIGGSDVIRFVQHDASEEAGWTTLFDTTEEAFGPVTTLVNNAGIGVPKSVERTTTEEWRDVLSVNLDGVFFGTRLGIQRMKNKGLGASIINMSSIMGLVGAPAAGAYNASKGAVRIMSKSAALDCALKDYDVRVNTVHPGAIKTNSKDQLPGWEQAMSQRTATPMGHIGEPNDIAWICVYLASDESKFATGAEFVVDGGYTAQ

SEQ ID NO: 377 - DNA, 756 bp, Artificial Sequence
  Engineered Variant of Kred from Lactobacillus kefir
atgaccgatcgtctgaagcacaaagtagccatcatcaccggcgggacaatgggtatcggtttggcaatcgccgataaatttgtagaggagggtgcgaaagtagttattactggtcgtcacgcggatgtaggtgagaaagccgccaaatcaatcggtggcagtgatgttattcgctttgtccagcacgatgcgtccgaagaagcaggctggacgaccctgttcgacaccaccgaggaggcattcggcccggttacgaccctggtgaacaatgcagggattggggttccgaagagcgttgaacggactaccacggaggaatggagtgatgttctgtccgttaatctggatggtgtttttttcggcacccgtctgggcattcagcgcatgaaaaataaaggcttgggcgctagcatcatcaatatgagcagtattatggggatcgtaggcgctccggccgccggggcatacaacgcttccaagggggcggtacgtatcatgtcgaaaagcgcagcgctggattgcgcactgaaggactacgatgtgcgtgtcaacacagtacatccgggcgcgatcaagaccgaatcgaaggatcagctgccaggttgggagcaggcaatgtcacagcgtacggcgacccctatgggccacattggcgaaccgaatgacatcgcatggatctgtgtgtacctggcatctgacgaatcgaaatttgcgacgggtgcagaatttgtggtcgacggcgggtacaccgcacag

SEQ ID NO: 378 - protein, 252 aa, Artificial Sequence
  Engineered Variant of Kred from Lactobacillus kefir
MTDRLKHKVAIITGGTMGIGLAIADKFVEEGAKVVITGRHADVGEKAAKSIGGSDVIRFVQHDASEEAGWTTLFDTTEEAFGPVTTLVNNAGIGVPKSVERTTTEEWSDVLSVNLDGVFFGTRLGIQRMKNKGLGASIINMSSIMGIVGAPAAGAYNASKGAVRIMSKSAALDCALKDYDVRVNTVHPGAIKTESKDQLPGWEQAMSQRTATPMGHIGEPNDIAWICVYLASDESKFATGAEFVVDGGYTAQ

SEQ ID NO: 379 - DNA, 756 bp, Artificial Sequence
  Engineered Variant of Kred from Lactobacillus kefir
atgaccgatcgtctgaagcacaaagtagccatcatcaccggcgggacaatgggtatcggtttggcaatcgccgataaatttgtagaggagggtgcgaaagtagttattactggtcgtcacgcggatgtaggtgagaaagccgccaaatcaatcggtggcagtgatgttattcgctttgtccagcacgatgcgtccgaagaagcaggctggacgaccctgttcgacaccaccgaggaggcattcggcccggttacgaccctggtgaacaatgcagggattggggtaattaagagcgttgaacggactaccacggaggaatggcgtgatgttctgtccgttaatctggatggtgtttttttcggcacccgtctgggcattcagcgcatgaaaaataaaggcttgggcgctagcatcatcaatatgagcagtattatggggctggtaggcgctccggccgccggggcatacaacgcttccaagggggcggtacgtatcatgtcgaaaagcgcagcgctggattgcgcactgaaggactacgatgtgcgtgtcaacacagtacatccgggcgcgatccgcaccgagtcgaaggatcagctggaaggttgggagcaggcaatgtcacagcgtacggcgacccctatgggccacattggcgaaccgaatgacatcgcatggatctgtgtgtacctggcatctgacgaatcgaaatttgcgacgggtgcagaatttgtggtcgacggcgggtacaccgcacag

SEQ ID NO: 380 - protein, 252 aa, Artificial Sequence
  Engineered Variant of Kred from Lactobacillus kefir
MTDRLKHKVAIITGGTMGIGLAIADKFVEEGAKVVITGRHADVGEKAAKSIGGSDVIRFVQHDASEEAGWTTLFDTTEEAFGPVTTLVNNAGIGVIKSVERTTTEEWRDVLSVNLDGVFFGTRLGIQRMKNKGLGASIINMSSIMGLVGAPAAGAYNASKGAVRIMSKSAALDCALKDYDVRVNTVHPGAIRTESKDQLEGWEQAMSQRTATPMGHIGEPNDIAWICVYLASDESKFATGAEFVVDGGYTAQ

SEQ ID NO: 381 - DNA, 756 bp, Artificial Sequence
  Engineered Variant of Kred from Lactobacillus kefir
atgaccgatcgtctgaagcacaaagtagccatcatcaccggcgggacaatgggtatcggtttggcaatcgccgataaatttgtagaggagggtgcgaaagtagttattactggtcgtcacgcggatgtaggtgagaaagccgccaaatcaatcggtggcagtgatgttattcgctttgtccagcacgatgcgtccgaagaagcaggctggacgaccctgttcgacaccaccgaggaggcattcggcccggttacgaccctggtgaacaatgcagggattggggtaattaagagcgttgaacggactaccacggaggaatggcgtgatgttctgtccgttaatctggatggtgtttttttcggcacccgtctgggcattcagcgcatgaaaaataaaggcttgggcgctagcatcatcaatatgagcagtattatggggattgtaggcgctccggccgccggggcatacaacgcttccaagggggcggtacgtatcatgtcgaaaagcgcagcgctggattgcgcactgaaggactacgatgtgcgtgtcaacacagtacatccgggcgcgatcaagaccgagtcgaaggatcagctggaaggttgggagcaggcaatgtcacagcgtacggcgacccctatgggccacattggcgaaccgaatgacatcgcatggatctgtgtgtacctggcatctgacgaatcgaaatttgcgacgggtgcagaatttgtggtcgacggcgggtacaccgcacag

SEQ ID NO: 382 - protein, 252 aa, Artificial Sequence
  Engineered Variant of Kred from Lactobacillus kefir
MTDRLKHKVAIITGGTMGIGLAIADKFVEEGAKVVITGRHADVGEKAAKSIGGSDVIRFVQHDASEEAGWTTLFDTTEEAFGPVTTLVNNAGIGVIKSVERTTTEEWRDVLSVNLDGVFFGTRLGIQRMKNKGLGASIINMSSIMGIVGAPAAGAYNASKGAVRIMSKSAALDCALKDYDVRVNTVHPGAIKTESKDQLEGWEQAMSQRTATPMGHIGEPNDIAWICVYLASDESKFATGAEFVVDGGYTAQ

SEQ ID NO: 383 - DNA, 756 bp, Artificial Sequence
  Engineered Variant of Kred from Lactobacillus kefir
atgaccgatcgtctgaagcacaaagtagccatcatcaccggcgggacaatgggtatcggtttggcaatcgccgataaatttgtagaggagggtgcgaaagtagttattactggtcgtcacgcggatgtaggtgagaaagccgccaaatcaatcggtggcagtgatgttattcgctttgtccagcacgatgcgtccgaagaagcaggctggacgaccctgttcgacaccaccgaggaggcattcggcccggttacgaccctggtgaacaatgcagggattggggtaattaagagcgttgaacgcactaccacggaggaatggcgtgatgttctgtccgttaatctggatggtgtttttttcggcacccgtctgggcattcagcgcatgaaaaataaaggcttgggcgctagcatcatcaatatgagcagtattatggggatcgtaggcgctccggccgccggggcatacaacgcttccaagggggcggtacgtatcatgtcgaaaagcgcagcgctggattgcgcactgaaggactacgatgtgcgtgtcaacacagtacatccgggcgcgatcaagaccgaatcgaaggatcagctgccaggttgggagcaggcaatgtcacagcgtacggcgacccctatgggccacattggcgaaccgaatgacatcgcatggatctgtgtgtacctggcatctgacgaatcgaaatttgcgacgggtgcagaatttgtggtcgacggcgggtacaccgcacag

SEQ ID NO: 384 - protein, 252 aa, Artificial Sequence
  Engineered Variant of Kred from Lactobacillus kefir
MTDRLKHKVAIITGGTMGIGLAIADKFVEEGAKVVITGRHADVGEKAAKSIGGSDVIRFVQHDASEEAGWTTLFDTTEEAFGPVTTLVNNAGIGVIKSVERTTTEEWRDVLSVNLDGVFFGTRLGIQRMKNKGLGASIINMSSIMGIVGAPAAGAYNASKGAVRIMSKSAALDCALKDYDVRVNTVHPGAIKTESKDQLPGWEQAMSQRTATPMGHIGEPNDIAWICVYLASDESKFATGAEFVVDGGYTAQ

SEQ ID NO: 385 - DNA, 756 bp, Artificial Sequence
  Engineered Variant of Kred from Lactobacillus kefir
atgaccgatcgtctgaagcacaaagtagccatcatcaccggcgggacaatgggtatcggtttggcaatcgccgataaatttgtagaggagggtgcgaaagtagttattactggtcgtcacgcggatgtaggtgagaaagccgccaaatcaatcggtggcagtgatgttattcgctttgtccagcacgatgcgtccgaagaagcaggctggacgaccgtgttcgacaccaccgaggaggcattcggcccggttacgaccctggtgaacaatgcagggattggggtaattaagagcgttgaacggactaccacggaggaatggcgtgatgttctgtccgttaatctggatggtgtttttttcggcacccgtctgggcattcagcgcatgaaaaataaaggcttgggcgctagcatcatcaatatgagcagtattatggggctggtaggcgctccggccgccggggcatacaacgcttccaagggggcggtacgtatcatgtcgaaaagcgcagcgctggattgcgcactgaaggactacgatgtgcgtgtcaacacagtacatccgggcgcgatcaagaccgaatcgaaggatcagctggagggttgggagcaggcaatgtcacagcgtacggcgacccctatgggccacattggcgaaccgaatgacatcgcatggatctgtgtgtacctggcatctgacgaatcgaaatttgcgacgggtgcagaatttgtggtcgacggcgggtacaccgcacag

SEQ ID NO: 386 - protein, 252 aa, Artificial Sequence
  Engineered Variant of Kred from Lactobacillus kefir
MTDRLKHKVAIITGGTMGIGLAIADKFVEEGAKVVITGRHADVGEKAAKSIGGSDVIRFVQHDASEEAGWTTVFDTTEEAFGPVTTLVNNAGIGVIKSVERTTTEEWRDVLSVNLDGVFFGTRLGIQRMKNKGLGASIINMSSIMGLVGAPAAGAYNASKGAVRIMSKSAALDCALKDYDVRVNTVHPGAIKTESKDQLEGWEQAMSQRTATPMGHIGEPNDIAWICVYLASDESKFATGAEFVVDGGYTAQ

SEQ ID NO: 387 - DNA, 756 bp, Artificial Sequence
  Engineered Variant of Kred from Lactobacillus kefir
atgaccgatcgtctgaagcacaaagtagccatcatcaccggcgggacaatgggtatcggtttggcaatcgccgataaatttgtagaggagggtgcgaaagtagttattactggtcgtcacgcggatgtaggtgagaaagccgccaaatcaatcggtggcagtgatgttattcgctttgtccagcacgatgcgtccgaagaagcaggctggacgaccgtgttcgacaccaccgaggaggcattcggcccggttacgaccctggtgaacaatgcagggattggggttatcaagagcgttgaacgcactaccacggaggaatggcgtgatgttctgtccgttaatctggatggtgtttttttcggcacccgtctgggcattcagcgcatgaaaaataaaggcttgggcgctagcatcatcaatatgagcagtattatggggatcgtaggcgctccggccgccggggcatacaacgcttccaagggggcggtacgtatcatgtcgaaaagcgcagcgctggattgcgcactgaaggactacgatgtgcgtgtcaacacagtacatccgggcgcgatcaagaccgaatcgaaggatcagctggagggttgggagcaggcaatgtcacagcgtacggcgacccctatgggccacattggcgaaccgaatgacatcgcatggatctgtgtgtacctggcatctgacgaatcgaaatttgcgacgggtgcagaatttgtggtcgacggcgggtacaccgcacag

SEQ ID NO: 388 - protein, 252 aa, Artificial Sequence
  Engineered Variant of Kred from Lactobacillus kefir
MTDRLKHKVAIITGGTMGIGLAIADKFVEEGAKVVITGRHADVGEKAAKSIGGSDVIRFVQHDASEEAGWTTVFDTTEEAFGPVTTLVNNAGIGVIKSVERTTTEEWRDVLSVNLDGVFFGTRLGIQRMKNKGLGASIINMSSIMGIVGAPAAGAYNASKGAVRIMSKSAALDCALKDYDVRVNTVHPGAIKTESKDQLEGWEQAMSQRTATPMGHIGEPNDIAWICVYLASDESKFATGAEFVVDGGYTAQ

SEQ ID NO: 389 - DNA, 756 bp, Artificial Sequence
  Engineered Variant of Kred from Lactobacillus kefir
atgaccgatcgtctgaagcacaaagtagccatcatcaccggcgggacagccggtatcggtttggcaatcgccgataaatttgtagaggagggtgcgaaagtagttattactggtcgtcacgcggatgtaggtgagaaagccgccaaatcaatcggtggcagtgatgttattcgctttgtccagcacgatgcgtccgaagaagcaggctggacgaccctgttcgacaccaccgaggaggcattcggcccggttacgaccctggtgaacaatgcagggattggggtaattaagagcgttgaacggactaccacggaggaatggcgtgatgttctgtccgttaatcaggatggtgtttttttcggcacccgtctgggcattcagcgcatgaaaaataaaggcttgggcgctagcatcatcaatatgagcagtattatggggctggtaggcgctccggccgccggggcatacaacgcttccaagggggcggtacgtatcatgtcgaaaagcgcagcgctggattgcgcactgaaggactacgatgtgcgtgtcaacacagtacatccgggcgcgatcaagaccgagtcgaaggatcagctggaaggttgggagcaggcaatgtcacagcgtacggcgacccctatgggccacattggcgaaccgaatgacatcgcatggatctgtgtgtacctggcatctgacgaatcgaaatttgcgacgggtgcagaatttgtggtcgacggcgggtacaccgcacag

SEQ ID NO: 390 - protein, 252 aa, Artificial Sequence
  Engineered Variant of Kred from Lactobacillus kefir
MTDRLKHKVAIITGGTAGIGLAIADKFVEEGAKVVITGRHADVGEKAAKSIGGSDVIRFVQHDASEEAGWTTLFDTTEEAFGPVTTLVNNAGIGVIKSVERTTTEEWRDVLSVNQDGVFFGTRLGIQRMKNKGLGASIINMSSIMGLVGAPAAGAYNASKGAVRIMSKSAALDCALKDYDVRVNTVHPGAIKTESKDQLEGWEQAMSQRTATPMGHIGEPNDIAWICVYLASDESKFATGAEFVVDGGYTAQ

SEQ ID NO: 391 - DNA, 756 bp, Artificial Sequence
  Engineered Variant of Kred from Lactobacillus kefir
atgaccgatcgtctgaagcacaaagtagccatcatcaccggcgggacagccggtatcggtttggcaatcgccgataaatttgtagaggagggtgcgaaagtagttattactggtcgtcacgcggatgtaggtgagaaagccgccaaatcaatcggtggcagtgatgttattcgctttgtccagcacgatgcgtccgaagaagcaggctggacgaccgtgttcgacaccaccgaggaggcattcggcccggttacgaccctggtgaacaatgcagggattggggtaattaagagcgttgaacggactaccacggaggaatggcgtgatgttctgtccgttaatctggatggtgtttttttcggcacccgtctgggcattcagcgcatgaaaaataaaggcttgggcgctagcatcatcaatatgagcagtattatggggctggtaggcgctccggccgccggggcatacaacgcttccaagggggcggtacgtatcatgtcgaaaagcgcagcgctggattgcgcactgaaggactacgatgtgcgtgtcaacacagtacatccgggcgcgatcaagaccgaatcgaaggatcagctgccaggttgggagcaggcaatgtcacagcgtacggcgacccctatgggccacattggcgaaccgaatgacatcgcatggatctgtgtgtacctggcatctgacgaatcgaaatttgcgacgggtgcagaatttgtggtcgacggcgggtacaccgcacag

SEQ ID NO: 392 - protein, 252 aa, Artificial Sequence
  Engineered Variant of Kred from Lactobacillus kefir
MTDRLKHKVAIITGGTAGIGLAIADKFVEEGAKVVITGRHADVGEKAAKSIGGSDVIRFVQHDASEEAGWTTVFDTTEEAFGPVTTLVNNAGIGVIKSVERTTTEEWRDVLSVNLDGVFFGTRLGIQRMKNKGLGASIINMSSIMGLVGAPAAGAYNASKGAVRIMSKSAALDCALKDYDVRVNTVHPGAIKTESKDQLPGWEQAMSQRTATPMGHIGEPNDIAWICVYLASDESKFATGAEFVVDGGYTAQ

SEQ ID NO: 393 - DNA, 756 bp, Artificial Sequence
  Engineered Variant of Kred from Lactobacillus kefir
atgaccgatcgtctgaagcacaaagtagccatcatcaccggcgggacaatgggtatcggtttggcaatcgccgataaatttgtagaggagggtgcgaaagtagttattactggtcgtcacgcggatgtaggtgagaaagccgccaaatcaatcggtggcagtgatgttattcgctttgtccagcacgatgcgtccgaagaagcaggctggacgaccctgttcgacaccaccgaggaggcattcggcccggttacgaccctggtgaacaatgcagggattggggtaattaagagcgttgaacggactaccacggaggaatggcgtgatgttctgtccgttaatctggatggtgtttttttcggcacccgtctgggcattcagcgcatgaaaaataaaggcttgggcgctagcatcatcaatatgagcagtattatggggctggtaggcgctccggccgccggggcatacaacgcttccaagggggcggtacgtatcatgtcgaaaagcgcagcgctggattgcgcactgaaggactacgatgtgcgtgtcaacacagtacatccgggcgcgatcaagaccgagtcgaaggatggcctggaaggttgggagcaggcaatgtcacagcgtacggcgacccctatgggccacattggcgaaccgaatgacatcgcatggatctgtgtgtacctggcatctgacgaatcgaaatttgcgacgggtgcagaatttgtggtcgacggcgggtacaccgcacag

SEQ ID NO: 394 - protein, 252 aa, Artificial Sequence
  Engineered Variant of Kred from Lactobacillus kefir
MTDRLKHKVAIITGGTMGIGLAIADKFVEEGAKVVITGRHADVGEKAAKSIGGSDVIRFVQHDASEEAGWTTLFDTTEEAFGPVTTLVNNAGIGVIKSVERTTTEEWRDVLSVNLDGVFFGTRLGIQRMKNKGLGASIINMSSIMGLVGAPAAGAYNASKGAVRIMSKSAALDCALKDYDVRVNTVHPGAIKTESKDGLEGWEQAMSQRTATPMGHIGEPNDIAWICVYLASDESKFATGAEFVVDGGYTAQ

SEQ ID NO: 395 - DNA, 756 bp, Artificial Sequence
  Engineered Variant of Kred from Lactobacillus kefir
atgaccgatcgtctgaagcacaaagtagccatcatcaccggcgggacaatgggtatcggtttggcaatcgccgataaatttgtagaggagggtgcgaaagtagttattactggtcgtcacgcggatgtaggtgagaaagccgccaaatcaatcggtggcagtgatgttattcgctttgtccagcacgatgcgtccgaagaagcaggctggacgaccctgttcgacaccaccgaggaggcattcggcccggttacgaccctggtgaacaatgcagggattggggtaattaagagcgttgaacggactaccacggaggaatggcgtgatgttctgtccgttaatctggatggtgtttttttcggcacccgtctgggcattcagcgcatgaaaaataaaggcttgggcgctagcatcatcaatatgagcagtattatggggctggtaggcgctccggccgccggggcatacaacgcttccaagggggcggtacgtatcatgtcgaaaagcgcagcgctggattgcgcactgaaggactacgatgtgcgtgtcaacacagtacatccgggcgcgatcaagaccgagtcgaaggatcgcctggaaggttgggagcaggcaatgtcacagcgtacggcgacccctatgggccacattggcgaaccgaatgacatcgcatggatctgtgtgtacctggcatctgacgaatcgaaatttgcgacgggtgcagaatttgtggtcgacggcgggtacaccgcacag

SEQ ID NO: 396 - protein, 252 aa, Artificial Sequence
  Engineered Variant of Kred from Lactobacillus kefir
MTDRLKHKVAIITGGTMGIGLAIADKFVEEGAKVVITGRHADVGEKAAKSIGGSDVIRFVQHDASEEAGWTTLFDTTEEAFGPVTTLVNNAGIGVIKSVERTTTEEWRDVLSVNLDGVFFGTRLGIQRMKNKGLGASIINMSSIMGLVGAPAAGAYNASKGAVRIMSKSAALDCALKDYDVRVNTVHPGAIKTESKDRLEGWEQAMSQRTATPMGHIGEPNDIAWICVYLASDESKFATGAEFVVDGGYTAQ

SEQ ID NO: 397 - DNA, 756 bp, Artificial Sequence
  Engineered Variant of Kred from Lactobacillus kefir
atgaccgatcgtctgaagcacaaagtagccatcatcaccggcgggacaatgggtatcggtttggcaatcgccgataaatttgtagaggagggtgcgaaagtagttattactggtcgtcacgcggatgtaggtgagaaagccgccaaatcaatcggtggcagtgatgttattcgctttgtccagcacgatgcgtccgaagaacgtggctggacggacctgttcgacaccaccgaggaggcattcggcccggttacgaccctggtgaacaatgcagggattggggtaattaagagcgttgaacaaactactacggaggaatggcgtgatgttctgtccgttaatctggatggtgtttttttcggcacccgtctgggcattcagcgcatgaaaaataaaggcttgggcgctagcatcatcaatatgagcagtattatggggctggtaggcgctccgcaggccggggcatacaacgcttccaagggggcggtacgtatcatgtcgaaaagcgcagcgctggattgcgcactgaaggactacgatgtgcgtgtcaacacagtacatccgggcgcgatcaagaccgagtcgaaggatcagctggaaggttgggagcagctgatgtcacagcgtacggcgacccctatgggccacattggcgaaccgaatgacatcgcatggatctgtgtgtacctggcatctgacgaatcgaaatttgcgacgggtgcagaatttgtggtcgacggcgggtacaccgcacag

SEQ ID NO: 398 - protein, 252 aa, Artificial Sequence
  Engineered Variant of Kred from Lactobacillus kefir
MTDRLKHKVAIITGGTMGIGLAIADKFVEEGAKVVITGRHADVGEKAAKSIGGSDVIRFVQHDASEERGWTDLFDTTEEAFGPVTTLVNNAGIGVIKSVEQTTTEEWRDVLSVNLDGVFFGTRLGIQRMKNKGLGASIINMSSIMGLVGAPQAGAYNASKGAVRIMSKSAALDCALKDYDVRVNTVHPGAIKTESKDQLEGWEQLMSQRTATPMGHIGEPNDIAWICVYLASDESKFATGAEFVVDGGYTAQ

SEQ ID NO: 399 - DNA, 756 bp, Artificial Sequence
  Engineered Variant of Kred from Lactobacillus kefir
atgaccgatcgtctgaagcacaaagtagccatcatcaccggcgggacaatgggtatcggtttggcaatcgccgataaatttgtagaggagggtgcgaaagtagttattactggtcgtcacgcggatgtaggtgagaaagccgccaaatcaatcggtggcagtgatgttattcgctttgtccagcacgatgcgtccgaagaagagggctggacggacctgttcgacaccaccgaggaggcattcggcccggttacgaccctggtgaacaatgcagggattggggtaattaagagcgttgaaaagactactacggaggaatggcgtgatgttctgtccgttaatctggatggtgtttttttcggcacccgtctgggcattcagcgcatgaaaaataaaggcttgggcgctagcatcatcaatatgagcagtattatggggctggtaggcgctccgcaggccggggcatacaacgcttccaagggggcggtacgtatcatgtcgaaaagcgcagcgctggattgcgcactgaaggactacgatgtgcgtgtcaacacagtacatccgggcgcgatcaagaccgagtcgaaggatcagctggaaggttgggagcagctgatgtcacagcgtacggcgacccctatgggccacattggcgaaccgaatgacatcgcatggatctgtgtgtacctggcatctgacgaatcgaaatttgcgacgggtgcagaatttgtggtcgacggcgggtacaccgcacag

SEQ ID NO: 400 - protein, 252 aa, Artificial Sequence
  Engineered Variant of Kred from Lactobacillus kefir
MTDRLKHKVAIITGGTMGIGLAIADKFVEEGAKVVITGRHADVGEKAAKSIGGSDVIRFVQHDASEEEGWTDLFDTTEEAFGPVTTLVNNAGIGVIKSVEKTTTEEWRDVLSVNLDGVFFGTRLGIQRMKNKGLGASIINMSSIMGLVGAPQAGAYNASKGAVRIMSKSAALDCALKDYDVRVNTVHPGAIKTESKDQLEGWEQLMSQRTATPMGHIGEPNDIAWICVYLASDESKFATGAEFVVDGGYTAQ

SEQ ID NO: 401 - DNA, 756 bp, Artificial Sequence
  Engineered Variant of Kred from Lactobacillus kefir
atgaccgatcgtctgaagcacaaagtagccatcatcaccggcgggacaatgggtatcggtttggcaatcgccgataaatttgtagaggagggtgcgaaagtagttattactggtcgtcacgcggatgtaggtgagaaagccgccaaatcaatcggtggcagtgatgttattcgctttgtccagcacgatgcgtccgaagaagcgggctggacgacgctgttcgacaccaccgaggaggcattcggcccggttacgaccctggtgaacaatgcagggattggggtaattaagagcgttgaaatgactactacggaggaatggcgtgatgttctgtccgttaatctggatggtgtttttttcggcacccgtctgggcattcagcgcatgaaaaataaaggcttgggcgctagcatcatcaatatgagcagtattatggggctggtaggcgctccggccgccggggcatacaacgcttccaagggggcggtacgtatcatgtcgaaaagcgcagcgctggattgcgcactgaaggactacgatgtgcgtgtcaacacagtacatccgggcgcgatcaagaccgagtcgaaggatcagctggaaggttgggagcagctgatgtcacagcgtacggcgacccctatgggccacattggcgaaccgaatgacatcgcatggatctgtgtgtacctggcatctgacgaatcgaaatttgcgacgggtgcagaatttgtggtcgacggcgggtacaccgcacag

SEQ ID NO: 402 - protein, 252 aa, Artificial Sequence
  Engineered Variant of Kred from Lactobacillus kefir
MTDRLKHKVAIITGGTMGIGLAIADKFVEEGAKVVITGRHADVGEKAAKSIGGSDVIRFVQHDASEEAGWTTLFDTTEEAFGPVTTLVNNAGIGVIKSVEMTTTEEWRDVLSVNLDGVFFGTRLGIQRMKNKGLGASIINMSSIMGLVGAPAAGAYNASKGAVRIMSKSAALDCALKDYDVRVNTVHPGAIKTESKDQLEGWEQLMSQRTATPMGHIGEPNDIAWICVYLASDESKFATGAEFVVDGGYTAQ

SEQ ID NO: 403 - DNA, 756 bp, Artificial Sequence
  Engineered Variant of Kred from Lactobacillus kefir
atgaccgatcgtctgaagcacaaagtagccatcatcaccggcgggacaatgggtatcggtttggcaatcgccgataaatttgtagaggagggtgcgaaagtagttattactggtcgtcacgcggatgtaggtgagaaagccgccaaatcaatcggtggcagtgatgttattcgctttgtccagcacgatgcgtccgaagaacgtggctggacgcgcctgttcgacaccaccgaggaggcattcggcccggttacgaccctggtgaacaatgcagggattggggtaattaagagcgttgaacggactaccacggaggaatggcgtgatgttctgtccgttaatctggatggtgtttttttcggcacccgtgagggcattcagcgcatgaaaaataaaggcttgggcgctagcatcatcaatatgagcagtattatggggctggtaggcgctccggccgccggggcatacaacgcttccaagggggcggtacgtatcatgtcgaaaagcgcagcgctggattgcgcactgaaggactacgatgtgcgtgtcaacacagtacatccgggcgcgatcaagaccgagtcgaaggatcagctggaaggttgggagcaggcaatgtcacagcgtacggcgacccctatgggccacattggcgaaccgaatgacatcgcatggatctgtgtgtacctggcatctgacgaatcgaaatttgcgacgggtgcagaatttgtggtcgacggcgggtacaccgcacag

SEQ ID NO: 404 - protein, 252 aa, Artificial Sequence
  Engineered Variant of Kred from Lactobacillus kefir
MTDRLKHKVAIITGGTMGIGLAIADKFVEEGAKVVITGRHADVGEKAAKSIGGSDVIRFVQHDASEERGWTRLFDTTEEAFGPVTTLVNNAGIGVIKSVERTTTEEWRDVLSVNLDGVFFGTREGIQRMKNKGLGASIINMSSIMGLVGAPAAGAYNASKGAVRIMSKSAALDCALKDYDVRVNTVHPGAIKTESKDQLEGWEQAMSQRTATPMGHIGEPNDIAWICVYLASDESKFATGAEFVVDGGYTAQ

SEQ ID NO: 405 - DNA, 756 bp, Artificial Sequence
  Engineered Variant of Kred from Lactobacillus kefir
atgaccgatcgtctgaagcacaaagtagccatcatcaccggcgggacaatgggtatcggtttggcaatcgccgataaatttgtagaggagggtgcgaaagtagttattactggtcgtcacgcggatgtaggtgagaaagccgccaaatcaatcggtggcagtgatgttattcgctttgtccagcacgatgcgtccgaagaacgtggctggacgcgcctgttcgacaccaccgaggaggcattcggcccggttacgaccctggtgaacaatgcagggattggggtaattaagagcgttgaacgcactactacggaggaatggcgtgatgttctgtccgttaatctggatggtgtttttttcggcacccgtgagggcattcagcgcatgaaaaataaaggcttgggcgctagcatcatcaatatgagcagtattatggggctggtaggcgctccgcaggccggggcatacaacgcttccaagggggcggtacgtatcatgtcgaaaagcgcagcgctggattgcgcactgaaggactacgatgtgcgtgtcaacacagtacatccgggcgcgatcaagaccgagtcgaaggatcagctggaaggttgggagcaggcaatgtcacagcgtacggcgacccctatgggccacattggcgaaccgaatgacatcgcatggatctgtgtgtacctggcatctgacgaatcgaaatttgcgacgggtgcagaatttgtggtcgacggcgggtacaccgcacag

SEQ ID NO: 406 - protein, 252 aa, Artificial Sequence
  Engineered Variant of Kred from Lactobacillus kefir
MTDRLKHKVAIITGGTMGIGLAIADKFVEEGAKVVITGRHADVGEKAAKSIGGSDVIRFVQHDASEERGWTRLFDTTEEAFGPVTTLVNNAGIGVIKSVERTTTEEWRDVLSVNLDGVFFGTREGIQRMKNKGLGASIINMSSIMGLVGAPQAGAYNASKGAVRIMSKSAALDCALKDYDVRVNTVHPGAIKTESKDQLEGWEQAMSQRTATPMGHIGEPNDIAWICVYLASDESKFATGAEFVVDGGYTAQ

SEQ ID NO: 407 - DNA, 756 bp, Artificial Sequence
  Engineered Variant of Kred from Lactobacillus kefir
atgaccgatcgtctgaagcacaaagtagccatcatcaccggcgggacaatgggtatcggtttggcaatcgccgataaatttgtagaggagggtgcgaaagtagttattactggtcgtcacgcggatgtaggtgagaaagccgccaaatcaatcggtggcagtgatgttattcgctttgtccagcacgatgcgtccgaagaagcgggctggacggacctgttcgacaccaccgaggaggcattcggcccggttacgaccctggtgaacaatgcagggattggggtaattaagagcgttgaacggactaccacggaggaatggcgtgatgttctgtccgttaatctggatggtgtttttttcggcacccgtctgggcattcagcgcatgaaaaataaaggcttgggcgctagcatcatcaatatgagcagtattatggggctggtaggcgctccgcaggccggggcatacaacgcttccaagggggcggtacgtatcatgtcgaaaagcgcagcgctggattgcgcactgaaggactacgatgtgcgtgtcaacacagtacatccgggcgcgatcaagaccgagtcgaaggatcagctggaaggttgggagcaggcaatgtcacagcgtacggcgacccctatgggccacattggcgaaccgaatgacatcgcatggatctgtgtgtacctggcatctgacgaatcgaaatttgcgacgggtgcagaatttgtggtcgacggcgggtacaccgcacag

SEQ ID NO: 408 - protein, 252 aa, Artificial Sequence
  Engineered Variant of Kred from Lactobacillus kefir
MTDRLKHKVAIITGGTMGIGLAIADKFVEEGAKVVITGRHADVGEKAAKSIGGSDVIRFVQHDASEEAGWTDLFDTTEEAFGPVTTLVNNAGIGVIKSVERTTTEEWRDVLSVNLDGVFFGTRLGIQRMKNKGLGASIINMSSIMGLVGAPQAGAYNASKGAVRIMSKSAALDCALKDYDVRVNTVHPGAIKTESKDQLEGWEQAMSQRTATPMGHIGEPNDIAWICVYLASDESKFATGAEFVVDGGYTAQ

SEQ ID NO: 409 - DNA, 756 bp, Artificial Sequence
  Engineered Variant of Kred from Lactobacillus kefir
atgaccgatcgtctgaagcacaaagtagccatcatcaccggcgggacaatgggtatcggtttggcaatcgccgataaatttgtagaggagggtgcgaaagtagttattactggtcgtcacgcggatgtaggtgagaaagccgccaaatcaatcggtggcagtgatgttattcgctttgtccagcacgatgcgtccgaagaacgtggctggacgacgctgttcgacaccaccgaggaggcattcggcccggttacgaccctggtgaacaatgcagggattggggtaattaagagcgttgaacggactaccacggaggaatggcgtgatgttctgtccgttaatctggatggtgtttttttcggcacccgtgagggcattcagcgcatgaaaaataaaggcttgggcgctagcatcatcaatatgagcagtattatggggctggtaggcgctccggccgccggggcatacaacgcttccaagggggcggtacgtatcatgtcgaaaagcgcagcgctggattgcgcactgaaggactacgatgtgcgtgtcaacacagtacatccgggcgcgatcaagaccgagtcgaaggatcagctggaaggttgggagcagctgatgtcacagcgtacggcgacccctatgggccacattggcgaaccgaatgacatcgcatggatctgtgtgtacctggcatctgacgaatcgaaatttgcgacgggtgcagaatttgtggtcgacggcgggtacaccgcacag

SEQ ID NO: 410 - protein, 252 aa, Artificial Sequence
  Engineered Variant of Kred from Lactobacillus kefir
MTDRLKHKVAIITGGTMGIGLAIADKFVEEGAKVVITGRHADVGEKAAKSIGGSDVIRFVQHDASEERGWTTLFDTTEEAFGPVTTLVNNAGIGVIKSVERTTTEEWRDVLSVNLDGVFFGTREGIQRMKNKGLGASIINMSSIMGLVGAPAAGAYNASKGAVRIMSKSAALDCALKDYDVRVNTVHPGAIKTESKDQLEGWEQLMSQRTATPMGHIGEPNDIAWICVYLASDESKFATGAEFVVDGGYTAQ

SEQ ID NO: 411 - DNA, 756 bp, Artificial Sequence
  Engineered Variant of Kred from Lactobacillus kefir
atgaccgatcgtctgaagcacaaagtagccatcatcaccggcgggacaatgggtatcggtttggcaatcgccgataaatttgtagaggagggtgcgaaagtagttattactggtcgtcacgcggatgtaggtgagaaagccgccaaatcaatcggtggcagtgatgttattcgctttgtccagcacgatgcgtccgaagaacgtggctggacgacgctgttcgacaccaccgaggaggcattcggcccggttacgaccctggtgaacaatgcagggattggggtaattaagagcgttgaacaaactactacggaggaatggcgtgatgttctgtccgttaatctggatggtgtttttttcggcacccgtgagggcattcagcgcatgaaaaataaaggcttgggcgctagcatcatcaatatgagcagtattatggggctggtaggcgctccgcaggccggggcatacaacgcttccaagggggcggtacgtatcatgtcgaaaagcgcagcgctggattgcgcactgaaggactacgatgtgcgtgtcaacacagtacatccgggcgcgatcaagaccgagtcgaaggatcagctggaaggttgggagcagctgatgtcacagcgtacggcgacccctatgggccacattggcgaaccgaatgacatcgcatggatctgtgtgtacctggcatctgacgaatcgaaatttgcgacgggtgcagaatttgtggtcgacggcgggtacaccgcacag

SEQ ID NO: 412 - protein, 252 aa, Artificial Sequence
  Engineered Variant of Kred from Lactobacillus kefir
MTDRLKHKVAIITGGTMGIGLAIADKFVEEGAKVVITGRHADVGEKAAKSIGGSDVIRFVQHDASEERGWTTLFDTTEEAFGPVTTLVNNAGIGVIKSVEQTTTEEWRDVLSVNLDGVFFGTREGIQRMKNKGLGASIINMSSIMGLVGAPQAGAYNASKGAVRIMSKSAALDCALKDYDVRVNTVHPGAIKTESKDQLEGWEQLMSQRTATPMGHIGEPNDIAWICVYLASDESKFATGAEFVVDGGYTAQ

SEQ ID NO: 413 - DNA, 756 bp, Artificial Sequence
  KRED Variants
atgaccgatcgtctgaagcacaaagtagccatcatcaccggcgggacaatgggtatcggtttggcaatcgccgataaatttgtagaggagggtgcgaaagtagttattactggtcgtcacgcggatgtaggtgagaaagccgccaaatcaatcggtggcagtgatgttattcgctttgtccagcacgatgcgtccgaagaagcaggctggacgaccctgttcgacaccaccgaggaggcattcggcccggttacgaccctggtgaacaatgcaggggcaggggtcattaagagcgttgaacggactaccacggaggaatggcgtgatgttctgtccgttaatctggatggtgtttttttcggcacccgtctgggcattcagcgcatgaaaaataaaggcttgggcgctagcatcatcaatatgagcagtattatggggctggtaggcgctccggccgccggggcatacaacgcttccaagggggcggtacgtatcatgtcgaaaagcgcagcgctggattgcgcactgaaggactacgatgtgcgtgtcaacacagtacatccgggcgcgatcaagaccgagcgcaaggatcagctggatggttgggagcaggcaatgtcacagcgtacggcgacccctatgggccacattggcgaaccgaatgacatcgcatggatctgtgtgtacctggcatctgacgaatcgaaatttgcgacgggtgcagaatttgtggtcgacggcgggtacaccgcacag

SEQ ID NO: 414 - protein, 252 aa, Artificial Sequence
  KRED Variants
MTDRLKHKVAIITGGTMGIGLAIADKFVEEGAKVVITGRHADVGEKAAKSIGGSDVIRFVQHDASEEAGWTTLFDTTEEAFGPVTTLVNNAGAGVIKSVERTTTEEWRDVLSVNLDGVFFGTRLGIQRMKNKGLGASIINMSSIMGLVGAPAAGAYNASKGAVRIMSKSAALDCALKDYDVRVNTVHPGAIKTERKDQLDGWEQAMSQRTATPMGHIGEPNDIAWICVYLASDESKFATGAEFVVDGGYTAQ

SEQ ID NO: 415 - DNA, 756 bp, Artificial Sequence
  KRED Variants
atgaccgatcgtctgaagcacaaagtagccatcgtcaccggcgggacagcgggtatcggtttggcaatcgccgataaatttgtagaggagggtgcgaaagtagttattactggtcgtcacgcggatgtaggtgagaaagccgccaaatcaatcggtggcagtgatgttattcgctttgtccagcacgatgcgtccgaagaagcaggctggacgagcctgttcgacaccaccgaggaagcattcggcccggttacgaccctggtgaacaatgcaggggcaggggtcatcaagagcgttgaacggactaccacggaggaatggcgtgatgttctgtccgttaatctggatggtgtttttttcggcacccgtctgggcattcagcgcatgaaaaataaaggcttgggcgctagcatcatcaatatgagcagtattatggggctggtaggcgctccgatggccggggcatacaacgcttccaagggggcggtacgtatcatgtcgaaaagcgcagcgctggattgcgcactgaaggactacgatgtgcgtgtcaacacagtacatccgggcgcgatcaagaccgaggctaaggatcagctggatggttgggagcaggcaatgtcacagcgtacggcgacccctatgggccacattggcgaaccgaatgacatcgcatggatctgtgtgtacctggcatctgacgaatcgaaatttgcgacgggtgcagaatttgtggtcgacggcgggtacaccgcacag

SEQ ID NO: 416 - protein, 252 aa, Artificial Sequence
  KRED Variants
MTDRLKHKVAIVTGGTAGIGLAIADKFVEEGAKVVITGRHADVGEKAAKSIGGSDVIRFVQHDASEEAGWTSLFDTTEEAFGPVTTLVNNAGAGVIKSVERTTTEEWRDVLSVNLDGVFFGTRLGIQRMKNKGLGASIINMSSIMGLVGAPMAGAYNASKGAVRIMSKSAALDCALKDYDVRVNTVHPGAIKTEAKDQLDGWEQAMSQRTATPMGHIGEPNDIAWICVYLASDESKFATGAEFVVDGGYTAQ

The invention claimed is:

1. A process for the preparation of dihydro-(rho)-isoalpha acids, comprising treating isoalpha acids with a ketoreductase enzyme or a microorganism expressing a gene that encodes the ketoreductase, wherein the ketoreductase enzyme comprises an amino acid sequence selected from the group consisting of SEQ ID NO: 414 and SEQ ID NO: 416, or wherein the ketoreductase enzyme or microorganism expressing a gene which encodes the ketoreductase is 99, 95 or 90 percent homologous to the ketoreductase enzyme selected from the group consisting of SEQ ID NO: 414 and SEQ ID NO: 416.

2. The process according to claim 1, wherein the process is carried out in an aqueous system.

3. The process according to claim 2, wherein the process is carried out under mild temperature and pH conditions.

4. The process according to claim 1, comprising addition of the ketoreductase enzyme and NADPH or NADP to a mixture of isoalpha acids followed by incubation.

5. The process according to claim 1, comprising adding the ketoreductase enzyme and NADPH or NADP to a mixture of isoalpha acids in the presence of isopropanol for cofactor recycling, followed by incubation.

6. The process according to claim 1, wherein the concentration of isoalpha acids, i.e. the substrate, is maximized to increase the volumetric productivity of the bioconversion.

7. The process according to claim 1, wherein the concentration of the cofactor NADPH or NADP in the mixture is minimized to improve the economics of the bioconversion.

8. The process according to claim 1, wherein the reaction is carried out in a vessel purged of air using an inert gas such as nitrogen or argon to prevent the production of degradation products.

9. The process according to claim 1, comprising adding the ketoreductase enzyme and NADPH or NADP to a mixture of isoalpha acids in the presence of another enzyme for cofactor recycling, followed by incubation.

10. The process according to claim 1, comprising adding a whole cell biocatalyst, wherein the whole cell biocatalyst is an immobilized microorganism expressing the gene which encodes a ketoreductase, to a mixture of isoalpha acids followed by incubation.

11. The process according to claim 1, comprising treating isoalpha acids with a growing microorganism expressing a gene which encodes the ketoreductase.

12. The process according to claim 1, comprising adding the ketoreductase enzyme, wherein the ketoreductase is thermostable, to an extract of isoalpha acids wherein heat is applied, and the mixture is incubated.

13. The process according to claim 1, wherein the ketoreductase specifically reduces cis-isohumulone, cis-isocohumulone, and cis-isoadhumulone.

14. The process according to claim 1, wherein the ketoreductase specifically reduces trans-isohumulone, trans-isocohumulone, and trans-isoadhumulone.

15. The process according to claim 1, comprising adding a mixture of 2 or more ketoreductase enzymes to reduce a mixture of cis- and trans-isoalpha acids, to their respective dihydroisoalpha acids.

16. The process according to claim 14, wherein the mixture of 2 or more ketoreductase enzymes produces a unique mixture of dihydroisoalpha acids that is distinct from that produced by chemical reducing agents, such as sodium borohydride.

17. The process according to claim 1, wherein the ketoreductase is 99 or 95, percent homologous to the ketoreductase enzyme selected from the group consisting of SEQ ID NO: 414 and SEQ ID NO: 416.

\* \* \* \* \*